United States Patent
Karlson et al.

(10) Patent No.: US 12,457,951 B2
(45) Date of Patent: Nov. 4, 2025

(54) ALTERATION OF FLAVOR TRAITS IN CONSUMER CROPS VIA DISABLEMENT OF THE MYROSINASE/GLUCOSINOLATE SYSTEM

(71) Applicant: PAIRWISE PLANTS SERVICES, INC., Durham, NC (US)

(72) Inventors: Dale Karlson, Cary, NC (US); HaeJin Kim, Durham, NC (US); Thomas J. Poorten, Durham, NC (US); Julius Mojica, Durham, NC (US)

(73) Assignee: Pairwise Plants Services, Inc., Durham, NC (US)

( * ) Notice: Subject to any disclaimer, the term of this patent is extended or adjusted under 35 U.S.C. 154(b) by 666 days.

(21) Appl. No.: 17/634,694

(22) PCT Filed: Aug. 14, 2020

(86) PCT No.: PCT/US2020/046483
§ 371 (c)(1),
(2) Date: Feb. 11, 2022

(87) PCT Pub. No.: WO2021/030738
PCT Pub. Date: Feb. 18, 2021

(65) Prior Publication Data
US 2022/0377995 A1 Dec. 1, 2022

Related U.S. Application Data

(60) Provisional application No. 62/886,458, filed on Aug. 14, 2019.

(51) Int. Cl.
*A01H 1/00* (2006.01)
*A01H 6/20* (2018.01)
*C12N 15/82* (2006.01)

(52) U.S. Cl.
CPC .............. *A01H 1/101* (2021.01); *A01H 6/20* (2018.05); *C12N 15/8201* (2013.01); *C12N 2310/20* (2017.05)

(58) Field of Classification Search
None
See application file for complete search history.

(56) References Cited

U.S. PATENT DOCUMENTS

| | | |
|---|---|---|
| 2005/0055744 A1 | 3/2005 | Quiros et al. |
| 2010/0317518 A1 | 12/2010 | Stevens et al. |
| 2014/0335063 A1 | 11/2014 | Cannon et al. |
| 2015/0067922 A1 | 3/2015 | Yang et al. |
| 2019/0225955 A1 | 7/2019 | Liu et al. |
| 2019/0225977 A1 | 7/2019 | Ulmasov et al. |

FOREIGN PATENT DOCUMENTS

WO 2019143926 A1 7/2019

OTHER PUBLICATIONS

Reintanz, et al. bus, a bushy *Arabidopsis* CYP79F1 knockout mutant with abolished synthesis of short-chain aliphatic glucosinolates (2001) The Plant Cell; vol. 13; pp. 351-367. (Year: 2001).*
Barth, C. et al. *Arabidopsis myrosinases* TGG1 and TGG2 have redundant function in glucosinolate breakdown and insect defense. (2006) The Plant Journal; vol. 46; pp. 549-562 (Year: 2006).*
Bhat, R., & Vyas, D. (Apr. 2, 2019). Myrosinase: insights on structural, catalytic, regulatory, and environmental interactions. Critical reviews in biotechnology, 39(4), 508-523. (Year: 2019).*
Thangstad, O. P., Gilde, B., Chadchawan, S., Seem, M., Husebye, H., Bradley, D., & Bones, A. M. (2004). Cell specific, cross-species expression of myrosinases in *Brassica napus, Arabidopsis thaliana* and *Nicotiana tabacum*. Plant Molecular Biology, 54, 597-611. (Year: 2004).*
Lazar et al. Transforming growth factor alpha: mutation of aspartic acid 47 and leucine 48 results in different biological activities. Mol Cell Biol. Mar. 1988;8(3): 1247-52. doi: 10.1128/mcb.8.3.1247-1252.1988. PMID: 3285178; PMCID: PMC363269. (Year: 1988).*
Borgen, B. H., Thangstad, O. P., Ahuja, I., Rossiter, J. T., & Bones, A. M. (2010). Removing the mustard oil bomb from seeds: transgenic ablation of myrosin cells in oilseed rape (*Brassica napus*) produces MINELESS seeds. Journal of Experimental Botany, 61(6), 1683-1697. (Year: 2010).*
NCBI Blast. Nucleotide [Internet]. [Oct. 4, 2017]. Bethesda (MD): National Library of Medicine (US), National Center for Biotechnology Information; [1988]—Accession No. XM_013896043.2, Predicted: *Brassica napus* myrosinase MA1 ( LOC106453838), mRNA. (Year: 2017).*
Stranger, B. E., & Mitchell-Olds, T. (2005). Nucleotide variation at the myrosinase-encoding locus, TGG1, and quantitative myrosinase enzyme activity variation in *Arabidopsis thaliana*. Molecular Ecology, 14(1), 295-309. (Year: 2005).*
Gasic, Ksenija, et al., "Transgenic Indian mustard (*Brassica juncea*) plants expressing an *Arabidopsis phytochelatin* synthase (AtPCS1) exhibit enhanced As and Cd tolerance", Plant Molecular Biology 64, 2007, 361-369.
International Search Report and the Written Opinion of the International Searching Authority corresponding to International Patent Application No. PCT/US2020/046483 (26 pages) (mailed Dec. 17, 2020).
Augustine, Rehna, et al., "Biotic elicitors and mechanical damage modulate glucosinolate accumulation by co-ordinated interplay of glucosinolate biosynthesis regulators in polyploid *Brassica juncea*", Phytochemistry 117, pp. 43-50 (2015).
Augustine, Rehna, et al., "Targeted silencing of BjMYB28 transcription factor gene directs development of low glucosinolate lines in oilseed *Brassica juncea*", Plant Biotechnology Journal. vol. 11(7), pp. 855-866 (2013).

(Continued)

*Primary Examiner* — Amjad Abraham
*Assistant Examiner* — Dequantarius Javon Speed
(74) *Attorney, Agent, or Firm* — Myers Bigel, P.A.

(57) ABSTRACT

The present invention is directed to methods and compositions for breeding plants with an altered flavor or odor profile. Particularly, next generation plant breeding technologies are utilized for producing plants with target genes edited to reduce pungency in flavor or odor.

8 Claims, 10 Drawing Sheets

Specification includes a Sequence Listing.

(56) References Cited

OTHER PUBLICATIONS

Barth, Carina, et al., "*Arabidopsis myrosinases* TGG1 and TGG2 have redundant function in glucosinolate breakdown and insect defense", The Plant Journal. vol. 46(4), pp. 549-562 (2006).
Bellostas, Natalia, et al., "Qualitative and quantitative evaluation of glucosinolates in cruciferous plants during their life cycles", Agroindustria. vol. 3, No. 3, pp. 5-10 (2004).
Burow, Meike, et al., "The Glucosinolate Biosynthetic Gene AOP2 Mediates Feed-back Regulation of Jasmonic Acid Signaling in *Arabidopsis*", Molecular Plant. vol. 8, pp. 1201-1212 (2015).
Chen, Ya-Zhou, et al., "Proteomics and Metabolomics of *Arabidopsis* Responses to Perturbation of Glucosinolate Biosynthesis", Molecular Plant. vol. 5, No. 5, pp. 1138-1150 (Apr. 2012).
Dosz, Edward B., et al., "Total Myrosinase Activity Estimates in *Brassica* Vegetable Produce", J. Agric. Food Chem. vol. 62(32), pp. 8094-8100 (2014).
Fahey, Jed W., et al., "The chemical diversity and distribution of glucosinolates and isothiocyanates among plants", Phytochemistry 56, pp. 5-51 (2001).
Golicz, Agnieszka A., et al., "The pangenome of an agronomically important crop plant *Brassica oleracea*", Nature Communications. 7:13390 (2016).
Halkier, Barbara Ann, et al., "Biology and Biochemistry of Glucosinolates", Annu. Rev. Plant Biol. vol. 57(1), pp. 303-333 (2006).
Harper, Andrea L., et al., "Associative transcriptomics of traits in the polyploid crop species *Brassica napus*", Nature Biotechnology. vol. 30, No. 8, pp. 798-802 (2012).
Neal, Calida S., et al., "The characterisation of AOP2: a gene associated with the biosynthesis of aliphatic alkenyl glucosinolates in *Arabidopsis thaliana*", BMC Plant Biology. 10:170 (2010).
Rask, Lars, et al., "Myrosinase: gene family evolution and herbivore defense in Brassicaceae", Plant Molecular Biology. vol. 42, pp. 93-113 (2000).
Reintanz, Birgit, et al., "bus, a Bushy *Arabidopsis* CYP79F1 Knockout Mutant with Abolished Synthesis of Short-Chain Aliphatic Glucosinolates", The Plant Cell. vol. 13, pp. 351-367 (Feb. 2001).
Sharma, Manisha, et al., "BjuB.CYP79F1 Regulates Synthesis of Propyl Fraction of Aliphatic Glucosinolates in Oilseed Mustard Brassica juncea: Functional Validation through Genetic and Transgenic Approaches", PLoS One. 11(2): e0150060, pp. 1-17 (2016).
Sønderby, Ida E., et al., "Biosynthesis of glucosinolates—gene discovery and beyond", Trends in Plant Science. vol. 15, No. 5, pp. 283-290 (2010).
Thangstad, Ole Petter, et al., "The myrosinase (thioglucoside glucohydrolase) gene family in Brassicaceae", Plant Molecular Biology. vol. 23, pp. 511-524 (1993).
Xu, Zhiwei, et al., "Functional genomic analysis of *Arabidopsis thaliana* glycoside hydrolase family 1", Plant Molecular Biology. vol. 55, pp. 343-367 (2004).
Xue, Jiaping, et al., "The glucosinolate-degrading enzyme myrosinase in Brassicaceae is encoded by a gene family", Plant Molecular Biology. vol. 18, pp. 387-398 (1992).
Zhang, Jifang, et al., "Three genes encoding AOP2, a protein involved in aliphatic glucosinolate biosynthesis, are differentially expressed in *Brassica rapa*", Journal of Experimental Botany. vol. 66, No. 20, pp. 6205-6218 (2015).
International Search Report and Written Opinion corresponding to International Patent Application No. PCT/US2023/070367; mailed Nov. 8, 2023 (15 pages).
Bell, Luke, et al., "Taste and Flavor Perceptions of Glucosinolates, Isothiocyanates, and Related Compounds", Molecular Nutrition & Food Research. 62(18): 1700990 (2018).
Karlson, Dale, et al., "Targeted Mutagenesis of the Multicopy Myrosinase Gene Family in Allotetraploid *Brassica juncea* Reduces Pungency in Fresh Leaves across Environments", Plants, 11, 2494 (2022).
Tantikanjana, Titima, et al., "Functional Analysis of the Tandem-Duplicated P450 Genes SPS/BUS/CYP79F1 and CYP79F2 in Glucosinolate Biosynthesis and Plant Development by Ds Transposition-Generated Double Mutants", Plant Physiology. 135: 840-848, 2014.
Wieczorek, Martyna N., et al., "Bitter taste of *Brassica* vegetables: The role of genetic factors, receptors, isothiocyanates, glucosinolates, and flavor context", Critical Reviews in Food Science and Nutrition. DOI: 10.1080/10408398.2017.1353478 (11 pages), 2017.
Botti, et al., "Studies on the Mechanism of Myrosinase", The Journal of Biological Chemistry 270(35): 20530-20535, 1995.
Gonda, et al., "A Simple Method for On-Gel Detection of Myrosinase Activity", Molecules 23(9): 2204, 2018 (11 pages).
Palmieri, et al., "A Steady-State Kinetics Study of Myrosinase wih Direct Ultraviolet Spectrophotometric Assay", Analytical Biochemistry 123: 320-324, 1982.
Palmieri, et al., "Comparison of Methods for Determining Myrosinase Activity", J. Agric. Food Chem. 35: 617-621, 1987.
Piekarska, et al., "Myrosinase activity in different plant samples; optimisation of measurement conditions for spectrophotometric and pH-stat methods", Industrial Crops and Products 50: 58-67, 2013.
Wilkinson, et al., "Determination of Myrosinase (Thioglucoside Glucohydrolase) Activity by a Spectrophotometric Coupled Enzyme Assay", Analytical Biochemistry 139: 284-291, 1984.
Wittstock, et al., "Glucosinolate Breakdown in *Arabidopsis*: Mechanism, Regulation and Biological Significance", *Arabidopsis* Book 8: e0134, 2010 (14 pages).

\* cited by examiner

ALTERATION OF FLAVOR TRAITS IN CONSUMER CROPS VIA DISABLEMENT OF THE MYROSINASE/GLUCOSINOLATE SYSTEM

STATEMENT REGARDING ELECTRONIC FILING OF A SEQUENCE LISTING

A Sequence Listing in ASCII text format, submitted under 37 C.F.R. § 1.821, entitled 1499-40_ST25.txt, 1,321,132 bytes in size, generated on Jan. 27, 2025 and filed via EFS-Web, is provided in lieu of a paper copy. This Sequence Listing is hereby incorporated herein by reference into the specification for its disclosures.

PRIORITY

This application claims the benefit, under 35 U.S.C. § 119 (e), of U.S. Provisional Application No. 62/886,458 filed on Aug. 14, 2019, the entire contents of which is incorporated by reference herein.

FIELD

The present invention is directed to next generation plant breeding to provide desired traits to consumer crops, particularly a reduced pungent flavor, bitterness flavor, and/or odor traits.

BACKGROUND

Vegetables play an important role in food and nutritional security. Particularly, green leafy vegetables are considered an exceptional source for vitamins, minerals, and phenolic compounds.

Mineral nutrients like iron and calcium are higher in leafy vegetables than staple food grains. However, the Centers for Disease Control and Prevention (CDC) recently reported that just 1 in 10 adults meet the daily intake recommendations for fruits and vegetables. For consumers, multiple potential barriers exist for the consumption of fresh produce options, such as: cost, convenience, availability, and palatability/taste of the fresh produce. Among fresh produce, lettuce is commonly used as a major component for salads and provides additive options for sandwiches and burgers. Although lettuce is broadly available and commonly purchased by consumers, it lacks in nutrition value relative to other leafy green vegetables.

In recent years, leafy green vegetables such as kale have gained popularity as 'superfoods' and serve as a nutrient dense vegetable source for health-conscious consumers. In southern states, turnip and mustard greens, and collards are a common part of the diet. However, in order to minimize undesirable attributes associated with leafy greens, such as fibrous/tough leaves, bitterness, frilly textures and/or pungency, consumers often cook down the leafy greens to soften tissues and alter flavor/odor profiles with the incorporation of fats and other ingredients. Consequently, many of the nutrient-related benefits are reduced, as a result of the cooking process, and consumers are deprived from many of the direct benefits of consuming the fresh produce to begin with.

Among the most nutrient dense leafy green options available for consumers, mustard greens (*Brassica juncea*), are characterized by intraspecific diversity with variation of leaf traits such as color, size, texture, and heading morphology. If eaten fresh, mustard greens are pungent due to a reaction of myrosinase enzyme with its glucosinolate substrate, also known as 'mustard bomb.' Consequently, mustard greens are either cooked to minimize pungency, or consumed fresh in smaller quantities, or as baby greens.

Therefore, the present invention is directed to modifying undesirable attributes of plants, such as mustard greens, to increase consumption of fresh healthy leafy greens and fresh produce.

SUMMARY

The present disclosure provides a novel plant breeding method for promoting fresh green leafy plants for human consumption. The breeding method is capable of producing mustard plants in which the mustard bomb reaction is disarmed and/or plants with a reduced pungency and/or bitterness in flavor and/or odor. The present disclosure provides modification of genomic targets genetically associated with flavor and/or odor traits, in plants of interest, by, for example, gene editing systems as taught herein. Thus, gene editing methods are adopted to precisely manipulate genomic targets, which allow for production of mustard plants with a less pungent and/or less bitter flavor and/or odor, which will increase consumption of for example, leafy green vegetables by consumers. Furthermore, the present disclosure also teaches a method of producing gene-edited plants that are free from a foreign DNA and/or transgene(s).

One aspect of the invention provides a mustard (e.g., *Brassica*) plant or part thereof comprising at least one non-natural mutation in an endogenous gene encoding a cytochrome P450 mono-oxygenase (i.e., CYP79F1, homomethionine N-monooxygenase; EC 1.14.14.42), an endogenous gene encoding a 2-oxo acid-dependent dioxygenase (i.e., AOP2, 2-oxoglutarate-dependent dioxygenase; EC 1.14.11.M8) and/or an endogenous gene encoding a myrosinase (i.e., glucosinolase, thioglucosidase (e.g., β-thioglucosidase), thioglucoside glucohydrolase; EC 3.2.1.147 (EC 3.2.3.1 transferred to 3.2.1.147)). A mustard plant may have more than one copy of a myrosinase gene, with at least one (e.g., 1, 2, 3, 4 or more) of the myrosinase genes comprising one or more mutations (e.g., 1, 2, 3, 4, or more mutations). A mustard plant may have more than one copy of an AOP2 gene, with at least one (e.g., 1, 2, 3, 4 or more) of the AOP2 genes comprising one or more mutations (e.g., 1, 2, 3, 4, or more mutations).

A second aspect of the invention provides a mustard plant cell, comprising an editing system comprising: (a) a CRISPR-associated effector protein; and (b) a guide nucleic acid (gRNA, gDNA, crRNA, crDNA, sgRNA, sgDNA) comprising a spacer sequence with complementarity to an endogenous target gene encoding a CYP79F1, an endogenous target gene encoding an AOP2, and/or an endogenous target gene encoding an myrosinase.

A third aspect of the invention provides a mustard plant or part thereof (e.g., a plant cell) having reduced pungency or bitterness in flavor and/or odor (e.g., reduced hydrolysis of glucosinolates and/or reduced amounts/production of alkenyl glucosinolates and/or aliphatic glucosinolates) (as compared to a plant not comprising the edit and grown under the same conditions) comprising at least one non-natural mutation an endogenous myrosinase gene, an endogenous AOP2 gene and/or an endogenous CYP79F1 gene, wherein the at least one mutation is a substitution, insertion or a deletion that is introduced using an editing system that comprises a nucleic acid binding domain that binds to a target site in the endogenous myrosinase gene, in the endogenous AOP2 gene or in the endogenous CYP79F1 gene.

A fourth aspect of the invention provides a method of producing/breeding a transgene-free edited mustard plant, comprising: crossing the mustard plant of the invention with a transgene free mustard plant, thereby introducing the at least one non-natural mutation into the mustard plant that is transgene-free; and selecting a progeny mustard plant that comprises the at least one non-natural mutation and is transgene-free, thereby producing a transgene free edited mustard plant.

A fifth aspect of the invention provides a method of providing a plurality of mustard plants exhibiting reduced pungency or bitterness, the method comprising planting two or more plants of the invention in a growing area (e.g., a field (e.g., a cultivated field, an agricultural field), a growth chamber, a greenhouse, a recreational area, a lawn, and/or a roadside and the like), thereby providing a plurality of mustard plants exhibiting reduced pungency or bitterness as compared to a plurality of control mustard plants not comprising the mutation and grown under the same conditions.

A sixth aspect of the invention provides a method of generating variation in a mustard myrosinase gene, an AOP2 gene and/or a CYP79F1 gene, comprising: introducing an editing system into a mustard plant cell, wherein the editing system is targeted to a region of the myrosinase gene, a region of the AOP2 gene, and/or the region of a CYP79F1 gene; and contacting the region of the myrosinase gene, of the AOP2 gene and/or the CYP79F1 gene with the editing system, thereby introducing a mutation into the myrosinase gene, the AOP2 gene, and/or the CYP79F1 gene and generating variation in the mustard myrosinase gene, AOP2 gene and/or CYP79F1 gene.

A seventh aspect of the invention provides a method for editing a specific site in the genome of a mustard plant cell, the method comprising: cleaving, in a site specific manner, a target site within an endogenous myrosinase gene, an endogenous AOP2 gene and/or an endogenous CYP79F1 gene, thereby generating an edit in the endogenous myrosinase gene, the endogenous AOP2 gene and/or the endogenous CYP79F1 gene of the plant cell.

An eighth aspect provides a method for making a mustard plant, comprising: (a) contacting a population of mustard plant cells comprising a DNA sequence that encodes a wild type endogenous myrosinase, a wild type endogenous AOP2 and/or a wild type endogenous CYP79F1 with a nuclease linked to a DNA binding domain (e.g., editing system) that binds to a target sequence in the wild type endogenous myrosinase, the wild type endogenous AOP2 or the wild type endogenous CYP79F1, (b) selecting a mustard plant cell from said population in which at least one DNA sequence encoding the wild type endogenous myrosinase, the wild type endogenous AOP2 and/or the wild type endogenous CYP79F1 has been mutated, wherein the mutation comprises a deletion of at least one nucleotide in the at least one DNA sequence; and (c) growing the selected plant cell into a mustard plant.

A ninth aspect provides a method for reducing pungency and/or bitterness in flavor or aroma in a mustard plant or part thereof, comprising (a) contacting a mustard plant cell comprising a wild type endogenous myrosinase gene, a wild type endogenous AOP2 gene and/or a wild type endogenous CYP79F1 gene with a nuclease targeting the wild type endogenous myrosinase gene, the wild type endogenous AOP2 gene or the wild type endogenous CYP79F1 gene, wherein the nuclease is linked to a DNA binding domain that binds to a target site in the wild type endogenous myrosinase gene, the wild type endogenous AOP2 gene or the wild type endogenous CYP79F1 gene to produce a plant cell comprising a mutation in the wild type endogenous myrosinase gene, the wild type endogenous AOP2 gene or the wild type endogenous CYP79F1 gene; and (b) growing the plant cell into a plant comprising the mutation in the wild type endogenous myrosinase gene, the wild type endogenous AOP2 gene and/or the wild type endogenous CYP79F1 gene, thereby reducing pungency and/or bitterness in flavor or aroma in a mustard plant or part thereof.

A tenth aspect provides method for producing a mustard plant having a phenotype of reduced pungency and/or reduced bitterness, comprising (a) contacting a mustard plant cell comprising a wild type endogenous myrosinase gene, a wild type endogenous AOP2 gene and/or a wild type endogenous CYP79F1 gene with a nuclease targeting the wild type endogenous myrosinase gene, the wild type endogenous AOP2 gene or the wild type endogenous CYP79F1 gene, wherein the nuclease is linked to a DNA binding domain that binds to a target site in the wild type endogenous wild type endogenous myrosinase gene, the wild type endogenous AOP2 gene or the wild type endogenous CYP79F1 gene, (b) growing the plant cell into a mustard plant, thereby producing a mustard plant having a phenotype of reduced pungency and/or reduced bitterness as compared to a plant not comprising the edit and grown under the same conditions.

An eleventh aspect of the invention provides a method for producing a mustard plant or part thereof comprising at least one cell having a mutated endogenous myrosinase gene, a mutated endogenous AOP2 gene and/or a mutated endogenous CYP79F1 gene, the method comprising contacting a target site in an endogenous myrosinase gene, an endogenous AOP2 gene and/or an endogenous CYP79F1 gene in the mustard plant or plant part with a nuclease comprising a cleavage domain and a DNA-binding domain, wherein the DNA binding domain binds to a target site in the endogenous myrosinase gene, the endogenous AOP2 gene and/or the endogenous CYP79F1 gene, thereby producing the plant or part thereof comprising at least one cell having a mutated endogenous myrosinase gene, a mutated endogenous AOP2 gene and/or a mutated endogenous CYP79F1 gene.

A twelfth aspect of the invention provides a method of producing a mustard plant or part thereof comprising a mutated endogenous myrosinase gene, a mutated endogenous AOP2 gene and/or a mutated endogenous CYP79F1 gene and having a phenotype of reduced pungency and/or bitterness, the method comprising contacting a target site in an endogenous myrosinase gene, an endogenous AOP2 gene and/or an endogenous CYP79F1 gene with a nuclease comprising a cleavage domain and a DNA binding domain (e.g., editing system) comprising a nucleic acid binding domain that binds to the target site in the endogenous myrosinase gene, the endogenous AOP2 gene and/or the endogenous CYP79F1 gene, thereby producing a mustard plant or part thereof comprising a mutated endogenous myrosinase gene, a mutated endogenous AOP2 gene and/or a mutated endogenous CYP79F1 gene and having reduced pungency and/or bitterness as compared to a plant not comprising the edit and grown under the same conditions.

A thirteenth aspect provides a guide nucleic acid (e.g., gRNA, gDNA, crRNA, crDNA) that binds to a target site in an endogenous myrosinase gene, in an endogenous AOP2 gene or in an endogenous CYP79F1 gene.

In a fourteenth aspect, a system is provided comprising a guide nucleic acid of the invention and a CRISPR-Cas effector protein that associates with the guide nucleic acid of the invention.

A fifteenth aspect provides a gene editing system comprising a CRISPR-Cas effector protein in association with a guide nucleic acid, wherein the guide nucleic acid comprises a spacer sequence that binds to an endogenous myrosinase gene, an endogenous AOP2 gene or an endogenous CYP79F1 gene.

In a sixteenth aspect, a complex comprising a CRISPR-Cas effector protein comprising a cleavage domain and a guide nucleic acid, wherein the guide nucleic acid binds to a target site in an endogenous myrosinase gene, in an endogenous AOP2 gene or in an endogenous CYP79F1 gene, wherein the cleavage domain cleaves a target strand in the endogenous myrosinase gene, in the endogenous AOP2 gene or in the endogenous CYP79F1 gene.

In a seventeenth aspect, an expression cassette is provided, the expression cassette comprising a (a) polynucleotide encoding CRISPR-Cas effector protein comprising a cleavage domain and (b) a guide nucleic acid that binds to a target site in an endogenous myrosinase gene, in an endogenous AOP2 gene or in an endogenous CYP79F1 gene.

An eighteenth aspect of the invention provides a nucleic encoding a null allele of a myrosinase, a CYP79F1 or an AOP2.

In an additional aspect, a mustard plant or part thereof is provided comprising a nucleic acid of the invention.

In a further aspect, a mustard plant or part thereof is provided that exhibits reduced pungency and/or reduced bitterness in flavor and/or aroma as compared to a plant (or part thereof) not comprising the edit and grown under the same conditions.

Further provided are mustard plants comprising in their genome one or more mutated myrosinase genes, one or more mutated AOP2 genes and/or a CYP79F1 gene produced by the methods of the invention as well as polypeptides, polynucleotides, nucleic acid constructs, expression cassettes and vectors for making a plant of this invention.

These and other aspects of the invention are set forth in more detail in the description of the invention below.

BRIEF DESCRIPTION OF THE SEQUENCES

SEQ ID NOS: 1-17 are exemplary Cas12a amino acid sequences useful with this invention.

SEQ ID NOs: 18-20 are exemplary Cas12a nucleotide sequences useful with this invention.

SEQ ID NO:21-22 are exemplary regulatory sequences encoding a promoter and intron. SEQ ID NOS: 23-29 are exemplary cytosine deaminase sequences useful with this invention.

SEQ ID NOs: 30-34 are exemplary adenine deaminase amino acid sequences useful with this invention.

SEQ ID NO:35 is an exemplary uracil-DNA glycosylase inhibitor (UGI) sequences useful with this invention.

SEQ ID NOs: 36-38 provides an example of a protospacer adjacent motif position for a Type V CRISPR-Cas 12a nuclease.

SEQ ID NOs: 39-41 provide example peptide tags and affinity polypeptides useful with this invention.

SEQ ID NOs: 42-52 provide example RNA recruiting motifs and corresponding affinity polypeptides useful with this invention.

SEQ ID NOs: 53-54 are exemplary Cas9 polypeptide sequences useful with this invention. SEQ ID NOs: 55-65 are exemplary Cas9 polynucleotide sequences useful with this invention.

SEQ ID NOs: 66-78 are example wild type myrosinase genomic sequences (cdna).

SEQ ID NOs: 79-92 are example wild type myrosinase coding sequences (cds).

SEQ ID NOs: 93-105 are example wild type myrosinase polypeptides.

SEQ ID NOs: 106-112 are example CRISPR guides targeting myrosinase genes.

SEQ ID NO:113 is an example wild type CYP79F1 genomic sequence (cdna).

SEQ ID NO:114 is an example wild type CYP79F1 coding sequence (cds).

SEQ ID NO:115 is an example wild type CYP79F1 polypeptide.

SEQ ID NOs: 116-117 are example CRISPR guides targeting CYP79F1 genes.

SEQ ID NOs: 118-122 are example wild type AOP2 genomic sequences (cdna).

SEQ ID NOs: 123-127 are example wild type AOP2 coding sequences (cds).

SEQ ID NOs: 128-132 are example wild type AOP2 polypeptides.

SEQ ID NOs: 133-140 are example CRISPR guides targeting AOP2 genes.

SEQ ID NOS: 141-599 are example edited regions of myrosinase polynucleotide sequences.

SEQ ID NOs: 600-616 are example edited regions of AOP2 polynucleotide sequences.

SEQ ID NOs: 617-658 are example wild type myrosinase polypeptide sequences.

SEQ ID NOs: 659-673 are example wild type AOP2 polypeptide sequences.

SEQ ID NOs: 674-679 are example wild type CYP79F1 polypeptide sequences.

SEQ ID NOs: 680-721 are example wild type myrosinase polynucleotide sequences (cDNA).

SEQ ID NOs: 722-736 are example wild type AOP2 polynucleotide sequences (cDNA).

SEQ ID NOs: 737-742 are example wild type CYP79F1 polynucleotide sequences (cDNA).

SEQ ID NOs: 743-775 are example myrosinase orthologs.
SEQ ID NOs: 776-781 are example AOP2 orthologs.
SEQ ID NOs: 782-787 are example CYP79F1 orthologs.
SEQ ID NOs: 788-799 are example edited regions of CYP79F1 polynucleotide sequences.

SEQ ID NOs: 800-816 are example edited regions of AOP2 polynucleotide sequences.

BRIEF DESCRIPTION OF THE FIGURES

FIG. 2 provides an example myrosinase gene (SEQ ID NO:92) and translated protein sequences (SEQ ID NO:817 and SEQ ID NO:818) from *Brassica juncea* with example aligned guides.

Figure 4:
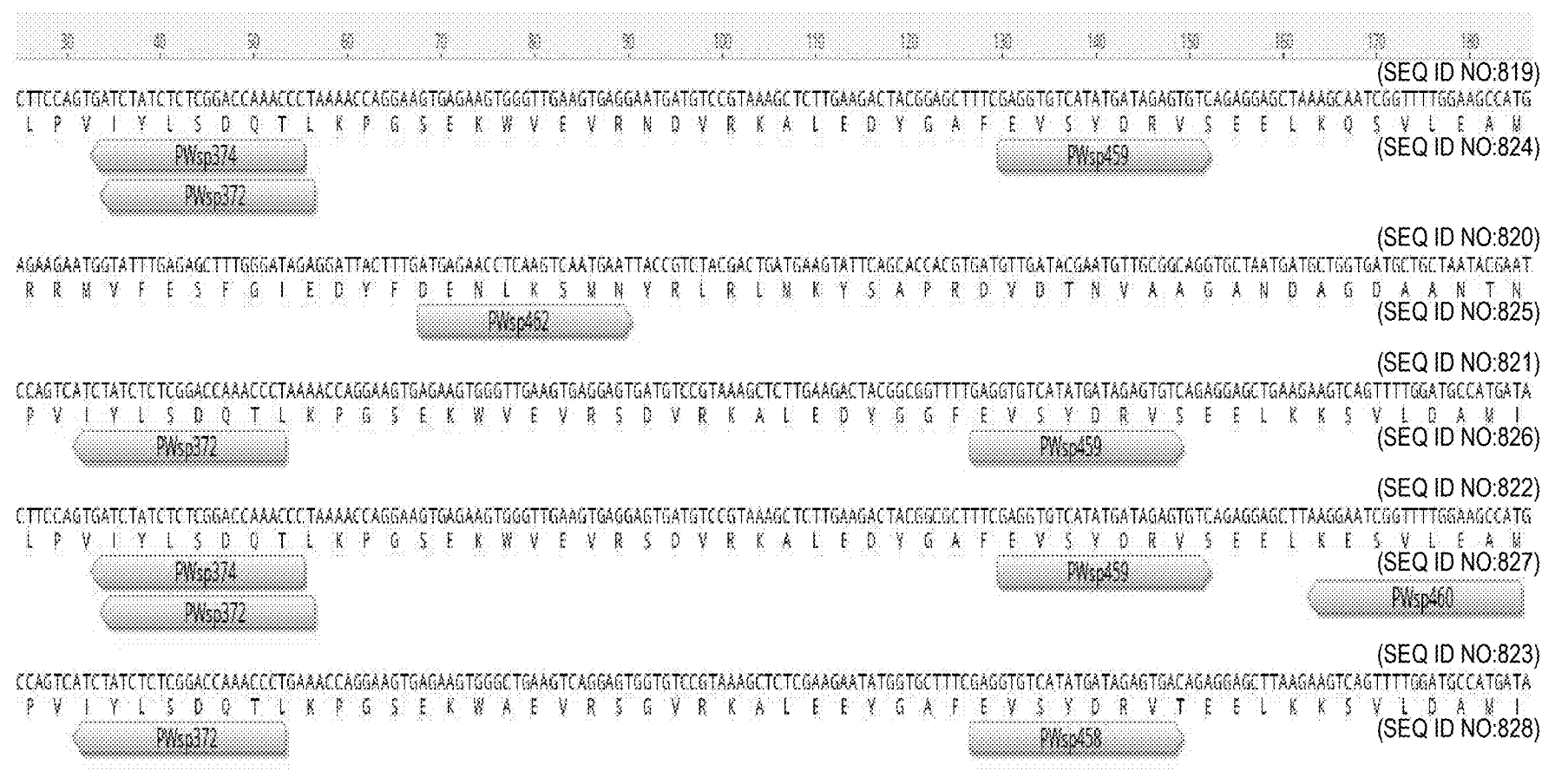

FIG. 4 provides five example AOP2 genes (SEQ ID NOs: 819-823) and translated protein sequences (SEQ ID NO:824-828) from *Brassica juncea* with aligned example guides.

Figure 5:
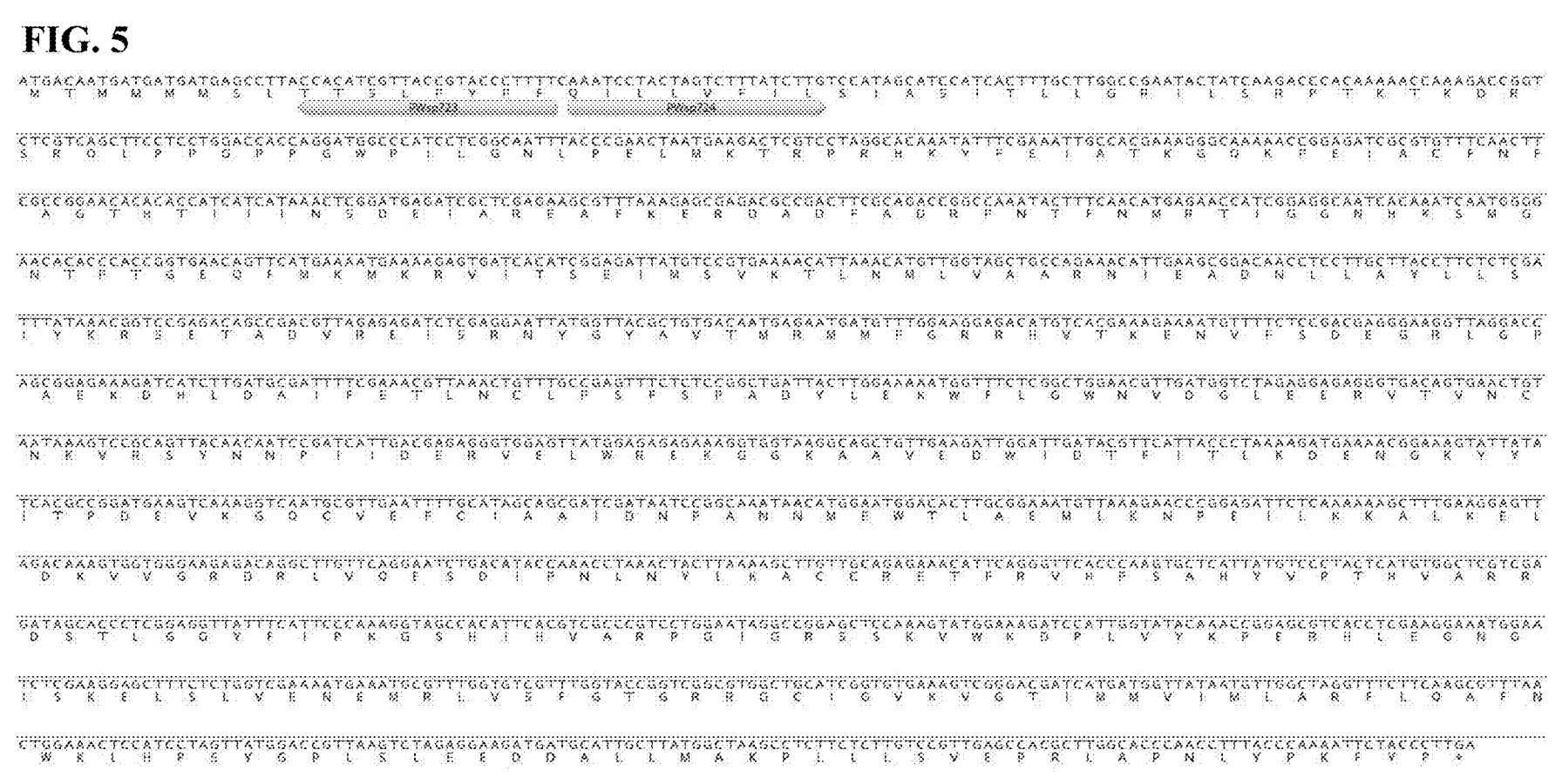

FIG. 5 provides an example CYP79F1 gene (SEQ ID NO:114) and translated protein sequence (SEQ ID NO:115) from *Brassica juncea* with aligned example guides.

DETAILED DESCRIPTION

Figure 1:
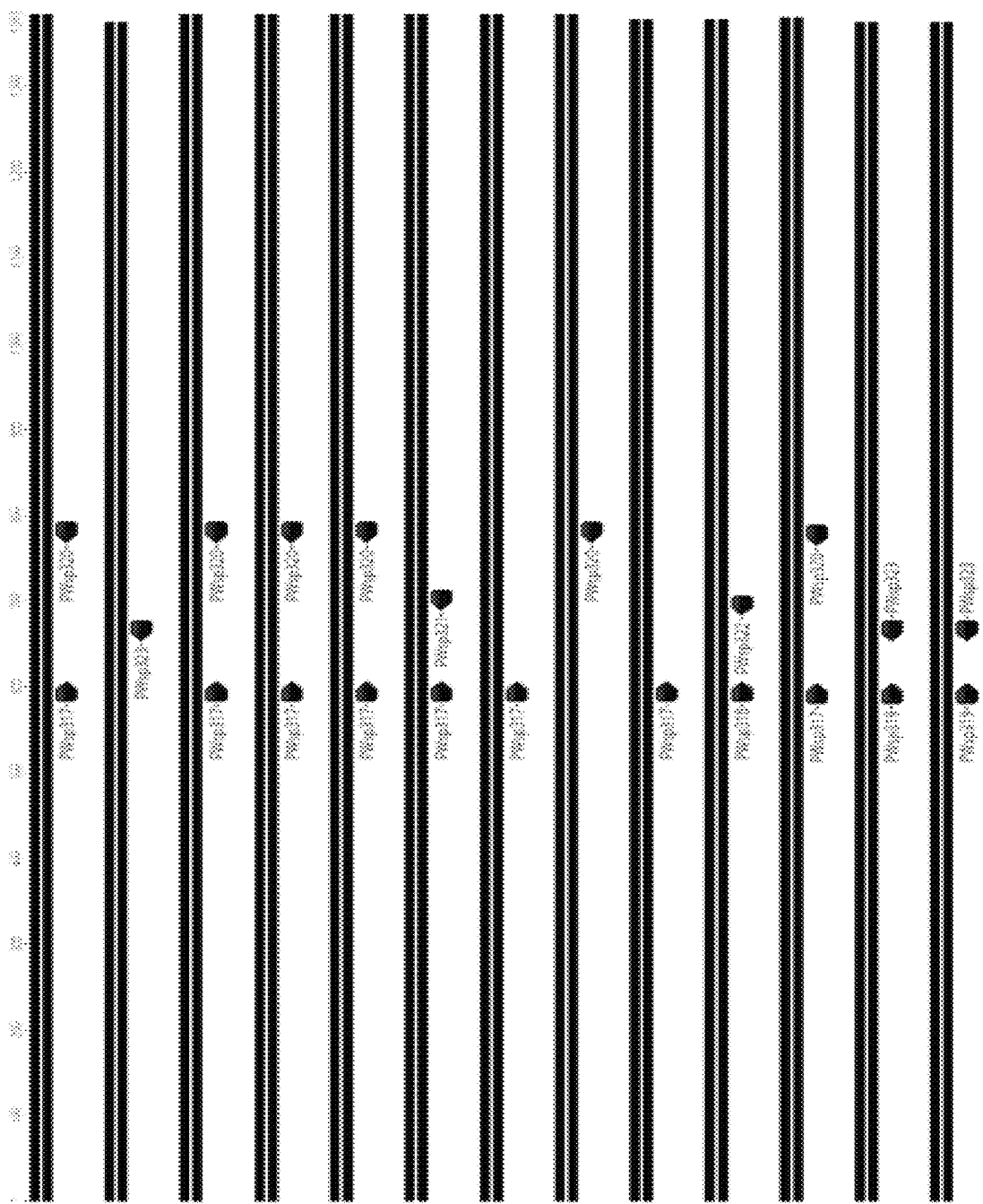
FIG. 1 provides thirteen example myrosinase genes from *Brassica juncea* with aligned example guides.
Figure 3:
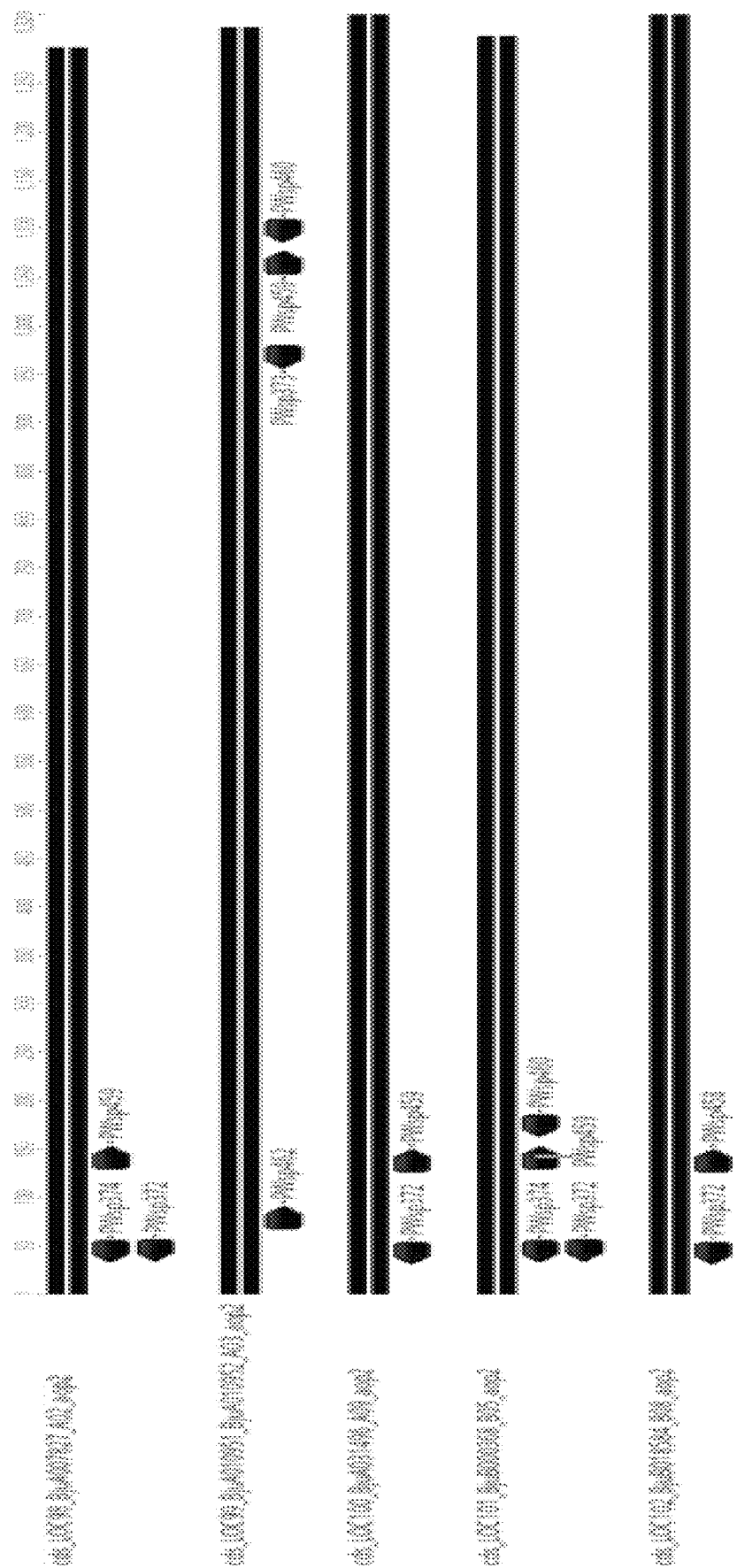
FIG. 3 provides five example AOP2 genes from *Brassica juncea* with aligned example guides.

Recent breeding efforts have focused on the development of new oilseed feedstock crop for biofuels (e.g. ethanol, biodiesel, bio-jet fuel), bio-industrial uses (e.g., bio-plastics, lubricants) and specialty fatty acids (e.g., erucic acid). Its limitation as a feed additive is its relatively high content of glucosinolate. Thus, the *Brassica* plants such as, *Brassica carinata, Brassica napus, Brassica rapa* and *Brassica juncea*, have been bred for low glucosinolate levels for oilseed and feed meal production for animal consumption. Using conventional plant breeding methods and/or genetic engineering techniques such as T-DNA insertion and RNAi, most efforts have focused on breeding low glucosinolate varieties for oil seed production and for feed for animals and livestock. However, these efforts have not been aimed at promoting fresh leafy greens for human consumption.

The present disclosure provides a method for the production of mustard plants (i.e., Brassicaceae plants), which maintains good nutritional values and impose less pungent and/or bitter flavor and/or odor traits to boost human consumption of, for example, fresh leafy green vegetables. Especially, the disclosure teaches prevention of the aforementioned 'mustard bomb' reaction, which minimizes pungency. The present disclosure provides a solution to produce gene-edited mustard plants giving rise to a desired trait such as a reduced pungency and/or reduced bitterness. Also, the present disclosure provides compositions, methods, and products related to the modification of plant cells to reduce pungency and/or bitterness and induce pleasant flavor and/or odor by disarming the mustard bomb reaction taught herein in an effort to promote consumption of fresh super greens, resulting in the gain of nutritional benefits from the fresh produce.

The present invention now will be described hereinafter with reference to the accompanying drawings and examples, in which embodiments of the invention are shown. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications, patent applications, patents and other references cited herein are incorporated by reference in their entireties for the teachings relevant to the sentence and/or paragraph in which the reference is presented.

Unless the context indicates otherwise, it is specifically intended that the various features of the invention described herein can be used in any combination. Moreover, the present invention also contemplates that in some embodiments of the invention, any feature or combination of features set forth herein can be excluded or omitted. To illustrate, if the specification states that a composition comprises components A, B and C, it is specifically intended that any of A, B or C, or a combination thereof, can be omitted and disclaimed singularly or in any combination.

The term "a" or "an" refers to one or more of that entity, i.e., can refer to a plural referent. As such, the terms "a" or "an", "one or more" and "at least one" are used interchangeably herein. In addition, reference to "an element" by the indefinite article "a" or "an" does not exclude the possibility that more than one of the elements is present, unless the context clearly requires that there is one and only one of the elements.

As used in this specification, the term "and/or" is used in this disclosure to mean either "and" or "or" unless indicated otherwise and encompasses any and all possible combinations of one or more of the associated listed items, as well as the lack of combinations when interpreted in the alternative ("or").

The term "comprise," "comprises" and "comprising" as used herein, specify the presence of the stated features, integers, steps, operations, elements, and/or components, but do not preclude the presence or addition of one or more other features, integers, steps, operations, elements, components, and/or groups thereof.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising."

As used in this application, the terms "about" and "approximately" are used as equivalents. Any numerals used in this application with or without about/approximately are meant to cover any normal fluctuations appreciated by one of ordinary skill in the relevant art. In certain embodiments, the term "approximately" or "about" refers to a range of values that fall within 10%, 9%, 8%, 7%, 6%, 5%, 4%, 3%, 2%, 1%, or less in either direction (greater than or less than) of the stated reference value unless otherwise stated or otherwise evident from the context (except where such number would exceed 100% of a possible value). Thus, the term "about," as used herein when referring to a measurable value such as an amount or concentration and the like, is meant to encompass variations of +10%, +5%, +1%, +0.5%, or even ±0.1% of the specified value as well as the specified value. For example, "about X" where X is the measurable value, is meant to include X as well as variations of +10%, +5%, +1%, +0.5%, or even ±0.1% of X. A range provided herein for a measureable value may include any other range and/or individual value therein.

As used herein, phrases such as "between X and Y" and "between about X and Y" should be interpreted to include X and Y. As used herein, phrases such as "between about X and Y" mean "between about X and about Y" and phrases such as "from about X to Y" mean "from about X to about Y."

Recitation of ranges of values herein are merely intended to serve as a shorthand method of referring individually to each separate value falling within the range, unless otherwise indicated herein, and each separate value is incorporated into the specification as if it were individually recited herein. For example, if the range 10 to 15 is disclosed, then 11, 12, 13, and 14 are also disclosed.

As used herein, the terms "increase," "increasing," "increased," "enhance," "enhanced," "enhancing," and "enhancement" (and grammatical variations thereof) describe an elevation of at least about 5%, 10%, 15%, 20%, 25%, 50%, 75%, 100%, 150%, 200%, 300%, 400%, 500% or more as compared to a control.

As used herein, the terms "reduce," "reduced," "reducing," "reduction," "diminish," and "decrease" (and grammatical variations thereof), describe, for example, a decrease of at least about 5%, 10%, 15%, 20%, 25%, 35%, 50%, 75%, 80%, 85%, 90%, 95%, 96%, 97%, 98%, 99%, 99.5%, 99.6%, 99.7%, 99.8%, 99.9%, or 100% as compared to a control. In particular embodiments, the reduction can result in no or essentially no (i.e., an insignificant amount, e.g., less than about 10% or even 5%) detectable activity or amount. For example, a plant comprising a mutation in gene encoding a enzyme involved in glucosinolate metabolism (biosynthesis or catabolism (e.g., glucosinolate breakdown) as described herein (e.g., myrosinase, AOP2, and/or CYP79F1 can exhibit reduced pungency and/or reduced bitterness that is reduced as compared to a plant when grown under the same environmental conditions.

As used herein, the terms "express," "expresses," "expressed" or "expression," and the like, with respect to a nucleic acid molecule and/or a nucleotide sequence (e.g., RNA or DNA) indicates that the nucleic acid molecule and/or a nucleotide sequence is transcribed and, optionally, translated. Thus, a nucleic acid molecule and/or a nucleotide sequence may express a polypeptide of interest or, for example, a functional untranslated RNA.

The terms "genetically engineered host cell," "recombinant host cell," and "recombinant strain" are used interchangeably herein and refer to host cells that have been genetically engineered by the methods of the present disclosure. Thus, the terms include a host cell (e.g., bacteria, yeast cell, fungal cell, CHO, human cell, plant cell, protoplast derived from plant, callus, etc.) that has been genetically altered, modified, or engineered, such that it exhibits an altered, modified, or different genotype and/or phenotype (e.g., when the genetic modification affects coding nucleic acid sequences), as compared to the naturally-occurring host cell from which it was derived. It is understood that the terms refer not only to the particular recombinant host cell in question, but also to the progeny or potential progeny of such a host cell.

The term "genetically engineered" may refer to any manipulation of a host cell's genome (e.g. by insertion or deletion of nucleic acids).

The term "next generation plant breeding" refers to a host of plant breeding tools and methodologies that are available to today's breeder. A key distinguishing feature of next generation plant breeding is that the breeder is no longer confined to relying upon observed phenotypic variation, in order to infer underlying genetic causes for a given trait. Rather, next generation plant breeding may include the utilization of molecular markers and marker assisted selection (MAS), such that the breeder can directly observe movement of alleles and genetic elements of interest from one plant in the breeding population to another, and is not confined to merely observing phenotype. Further, next generation plant breeding methods are not confined to utilizing natural genetic variation found within a plant population. Rather, the breeder utilizing next generation plant breeding methodology can access a host of modern genetic engineering tools that directly alter/change/edit the plant's underlying genetic architecture in a targeted manner, in order to bring about a phenotypic trait of interest. In aspects, the plants bred with a next generation plant breeding methodology are indistinguishable from a plant that was bred in a traditional manner, as the resulting end product plant could theoretically be developed by either method. In particular aspects, a next generation plant breeding methodology may result in a plant that comprises: a genetic modification that is a deletion of any size (e.g., resulting in a truncation); a genetic modification that is a single base pair substitution; a genetic modification that is an introduction of nucleic acid sequences from within the plant's natural gene pool (e.g. any plant that could be crossed or bred with a plant of interest) or from editing of nucleic acid sequences in a plant to correspond to a sequence known to occur in the plant's natural gene pool; and offspring of said plants.

The term "traditional plant breeding" refers to the utilization of natural variation found within a plant population as a source for alleles and genetic variants that impart a trait of a interest to a given plant. Traditional breeding methods make use of crossing procedures that rely largely upon observed phenotypic variation to infer causative allele association. That is, traditional plant breeding relies upon observations of expressed phenotype of a given plant to infer underlying genetic cause. These observations are utilized to inform the breeding procedure in order to move allelic variation into germplasm of interest. Further, traditional plant breeding has also been characterized as comprising random mutagenesis techniques, which can be used to introduce genetic variation into a given germplasm. These random mutagenesis techniques may include chemical and/or radiation-based mutagenesis procedures. Consequently, one key feature of traditional plant breeding, is that the breeder does not utilize a genetic engineering tool that directly alters/changes/edits the plant's underlying genetic architecture in a targeted manner, in order to introduce genetic diversity and bring about a phenotypic trait of interest.

The terms "polynucleotide," "nucleic acid," and "nucleotide sequence," used interchangeably herein, refers to a polymeric form of nucleotides of any length, either ribonucleotides or deoxyribonucleotides, or analogs thereof. This term refers to the primary structure of the molecule, and thus includes double- and single-stranded DNA, as well as double- and single-stranded RNA. This term includes, but is not limited to, single-, double-, or multistranded DNA or RNA, genomic DNA, cDNA, DNA-RNA hybrids, or a polymer comprising purine and pyrimidine bases or other natural, chemically or biochemically modified, non-natural, or derivatized nucleotide bases. It also includes modified nucleic acids such as methylated and/or capped nucleic acids, nucleic acids containing modified bases, backbone modifications, and the like. "Oligonucleotide" generally refers to polynucleotides of between about 5 and about 100 nucleotides of single- or double-stranded DNA. However, for the purposes of this disclosure, there is no upper limit to the length of an oligonucleotide. Oligonucleotides are also known as "oligomers" or "oligos" and may be isolated from genes, or chemically synthesized by methods known in the art. The terms "polynucleotide" "nucleic acid," and "nucleotide sequence" should be understood to include, as applicable to the embodiments being described, single-stranded (such as sense or antisense) and double-stranded polynucleotides.

The terms "peptide," "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones.

A "native" or "wild type" nucleic acid, nucleotide sequence, polypeptide or amino acid sequence refers to a naturally occurring or endogenous nucleic acid, nucleotide sequence, polypeptide or amino acid sequence. Thus, for example, a "wild type endogenous myrosinase gene" is a myrosinase gene that is naturally occurring in or endogenous to the reference organism, e.g., a mustard plant.

As used herein, the term "heterozygous" refers to a genetic status wherein different alleles reside at corresponding loci on homologous chromosomes.

As used herein, the term "homozygous" refers to a genetic status wherein identical alleles reside at corresponding loci on homologous chromosomes.

As used herein, the term "allele" refers to one of two or more different nucleotides or nucleotide sequences that occur at a specific locus.

A "null allele" is a nonfunctional allele caused by a genetic mutation that results in a complete lack of production of the corresponding protein or produces a protein that is non-functional.

A "dominant negative mutation" is a mutation that produces an altered gene product (e.g., having an aberrant function relative to wild type), which gene product adversely affects the function of the wild-type allele or gene product. For example, a "dominant negative mutation" may block a function of the wild type gene product. A dominant negative mutation may also be referred to as an "antimorphic mutation."

A "semi-dominant mutation" refers to a mutation in which the penetrance of the phenotype in a heterozygous organism is less than that observed for a homozygous organism.

A "weak loss-of-function mutation" is a mutation that results in a gene product having partial function or reduced function (partially inactivated) as compared to the wildtype gene product.

A "hypomorphic mutation" is a mutation that results in a partial loss of gene function, which may occur through reduced expression (e.g., reduced protein and/or reduced RNA) or reduced functional performance (e.g., reduced activity), but not a complete loss of function/activity. A "hypomorphic" allele is a semi-functional allele caused by a genetic mutation that results in production of the corresponding protein that functions at anywhere between 1% and 99% of normal efficiency.

As used herein, the terms "desired allele," "target allele" and/or "allele of interest" are used interchangeably to refer to an allele associated with a desired trait. In some embodiments, a desired allele may be associated with either an increase or a decrease (relative to a control) of or in a given trait, depending on the nature of the desired phenotype.

A marker is "associated with" a trait when said trait is linked to it and when the presence of the marker is an indicator of whether and/or to what extent the desired trait or trait form will occur in a plant/germplasm comprising the marker. Similarly, a marker is "associated with" an allele or chromosome interval when it is linked to it and when the presence of the marker is an indicator of whether the allele or chromosome interval is present in a plant/germplasm comprising the marker.

As used herein, the terms "backcross" and "backcrossing" refer to the process whereby a progeny plant is crossed back to one of its parents one or more times (e.g., 1, 2, 3, 4, 5, 6, 7, 8, etc.). In a backcrossing scheme, the "donor" parent refers to the parental plant with the desired gene or locus to be introgressed. The "recipient" parent (used one or more times) or "recurrent" parent (used two or more times) refers to the parental plant into which the gene or locus is being introgressed. For example, see Ragot, M. et al. Marker-assisted Backcrossing: A Practical Example, in TECHNIQUES ET UTILISATIONS DES MARQUEURS MOLECULAIRES LES COLLOQUES, Vol. 72, pp. 45-56 (1995); and Openshaw et al., Marker-assisted Selection in Backcross Breeding, in PROCEEDINGS OF THE SYMPOSIUM "ANALYSIS OF MOLECULAR MARKER DATA," pp. 41-43 (1994). The initial cross gives rise to the F1 generation. The term "BC1" refers to the second use of the recurrent parent, "BC2" refers to the third use of the recurrent parent, and so on.

As used herein, the terms "cross" or "crossed" refer to the fusion of gametes via pollination to produce progeny (e.g., cells, seeds or plants). The term encompasses both sexual crosses (the pollination of one plant by another) and selfing (self-pollination, e.g., when the pollen and ovule are from the same plant). The term "crossing" refers to the act of fusing gametes via pollination to produce progeny.

As used herein, the terms "introgression," "introgressing" and "introgressed" refer to both the natural and artificial transmission of a desired allele or combination of desired alleles of a genetic locus or genetic loci from one genetic background to another. For example, a desired allele at a specified locus can be transmitted to at least one progeny via a sexual cross between two parents of the same species, where at least one of the parents has the desired allele in its genome. Alternatively, for example, transmission of an allele can occur by recombination between two donor genomes, e.g., in a fused protoplast, where at least one of the donor protoplasts has the desired allele in its genome. The desired allele may be a selected allele of a marker, a QTL, a transgene, or the like. Offspring comprising the desired allele can be backcrossed one or more times (e.g., 1, 2, 3, 4, or more times) to a line having a desired genetic background, selecting for the desired allele, with the result being that the desired allele becomes fixed in the desired genetic background. For example, a marker associated with increased yield under non-water stress conditions may be introgressed from a donor into a recurrent parent that does not comprise the marker and does not exhibit increased yield under non-water stress conditions. The resulting offspring could then be backcrossed one or more times and selected until the progeny possess the genetic marker(s) associated with increased yield under non-water stress conditions in the recurrent parent background.

A "genetic map" is a description of genetic linkage relationships among loci on one or more chromosomes within a given species, generally depicted in a diagrammatic or tabular form. For each genetic map, distances between loci are measured by the recombination frequencies between them. Recombination between loci can be detected using a variety of markers. A genetic map is a product of the mapping population, types of markers used, and the polymorphic potential of each marker between different populations. The order and genetic distances between loci can differ from one genetic map to another.

As used herein, the term "genotype" refers to the genetic constitution of an individual (or group of individuals) at one or more genetic loci, as contrasted with the observable and/or detectable and/or manifested trait (the phenotype). Genotype is defined by the allele(s) of one or more known loci that the individual has inherited from its parents. The term genotype can be used to refer to an individual's genetic constitution at a single locus, at multiple loci, or more generally, the term genotype can be used to refer to an individual's genetic make-up for all the genes in its genome. Genotypes can be indirectly characterized, e.g., using markers and/or directly characterized by nucleic acid sequencing.

As used herein, the term "germplasm" refers to genetic material of or from an individual (e.g., a plant), a group of individuals (e.g., a plant line, variety or family), or a clone derived from a line, variety, species, or culture. The germplasm can be part of an organism or cell, or can be separate from the organism or cell. In general, germplasm provides genetic material with a specific genetic makeup that provides a foundation for some or all of the hereditary qualities of an organism or cell culture. As used herein, germplasm includes cells, seed or tissues from which new plants may be grown, as well as plant parts that can be cultured into a whole plant (e.g., leaves, stems, buds, roots, pollen, cells, etc.).

As used herein, the terms "cultivar" and "variety" refer to a group of similar plants that by structural or genetic features and/or performance can be distinguished from other varieties within the same species.

As used herein, the terms "exotic," "exotic line" and "exotic germplasm" refer to any plant, line or germplasm that is not elite. In general, exotic plants/germplasms are not derived from any known elite plant or germplasm, but rather are selected to introduce one or more desired genetic elements into a breeding program (e.g., to introduce novel alleles into a breeding program).

As used herein, the term "hybrid" in the context of plant breeding refers to a plant that is the offspring of genetically dissimilar parents produced by crossing plants of different lines or breeds or species, including but not limited to the cross between two inbred lines.

As used herein, the term "inbred" refers to a substantially homozygous plant or variety. The term may refer to a plant or plant variety that is substantially homozygous throughout the entire genome or that is substantially homozygous with respect to a portion of the genome that is of particular interest.

In some embodiments, a "portion" may encode a targeted region for producing a desired phenotype (e.g., reduced pungency and/or reduced bitterness as compared to a plant not having the edit and grown under the same environmental conditions). Thus, with respect to nucleic acids, the term "fragment" or "portion" refers to a nucleic acid that is reduced in length relative (e.g., reduced by 1, 2, 3, 4, 5, 6, 7, 8, 9, 10, 11, 12, 13, 14, 15, 16, 17, 18, 19, 20, 20, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 400, 450, 500, 550, 600, 650, 660, 670, 680, 690 or 700 or more nucleotides or any range or value therein) to a reference nucleic acid and that comprises, consists essentially of and/or consists of a nucleotide sequence of contiguous nucleotides identical or almost identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identical) to a corresponding portion of the reference nucleic acid. Such a nucleic acid fragment may be, where appropriate, included in a larger polynucleotide of which it is a constituent. As an example, a repeat sequence of guide nucleic acid of this invention may comprise a "portion" of a wild type CRISPR-Cas repeat sequence (e.g., a wild Type CRISR-Cas repeat; e.g., a repeat from the CRISPR Cas system of, for example, a Cas9, Cas12a (Cpf1), Cas12b, Cas12c (C2c3), Cas12d (CasY), Cas12e (CasX), Cas12g, Cas12h, Cas12i, C2c4, C2c5, C2c8, C2c9, C2c10, Cas14a, Cas14b, and/or a Cas14c, and the like). In some embodiments, a nucleic acid fragment may comprise, consist essentially of or consist of about 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 300, 350, 400, 450, 500, 550, 600, or 650, 700, 800, 900, 1000, 1100, 1200, 1300, 1400, 1500, 1600, 1700, 1800, 1900, 2000, 2100, 2200, 2250, 2300, 2350, 2400, 2450, 2500, 2550, 2600, 2650, 2700, 2750, 2800, 2900, 3000, 3500, 4000, 4500, 5000, 5500 or more consecutive nucleotides or any range or value therein of a nucleic acid encoding a myrosinase nucleic acid, an AOP2 nucleic acid, and/or a CYP79F1 nucleic acid.

In some embodiments, a nucleic acid fragment of a myrosinase gene (i.e., glucosinolase, thioglucosidase (e.g., β-thioglucosidase), thioglucoside glucohydrolase; EC 3.2.1.147 (EC 3.2.3.1 transferred to 3.2.1.147)), an AOP2 gene (i.e., a 2-oxo acid-dependent dioxygenase; EC 1.14.11.M8), and/or a CYP79F1 gene (i.e., a cytochrome P450 mono-oxygenase, homomethionine N-monooxygenase; EC 1.14.14.42) may be the result of a deletion of nucleotides from the 3' end, the 5' end, and/or from within the gene encoding a myrosinase protein, an AOP2 protein or a CYP79F1 protein. In some embodiments, a deletion of a portion of a gene encoding a myrosinase protein, an AOP2 protein or a CYP79F1 protein may comprise a deletion of a portion of consecutive nucleotides from the 5' end, the 3' end, from within, or from the 5' end through the end of the 3' end of the myrosinase gene, the AOP2 gene or the CYP79F1 gene. In some embodiments, a deletion of a portion of a gene encoding a myrosinase protein, a gene encoding an AOP2 protein or a gene encoding a CYP79F1 protein may comprise a deletion of a portion of at least 2 consecutive nucleotides from the 5' end, the 3' end, from within, or from the 5' end through the end of the 3' end of the myrosinase gene, the AOP2 gene or the CYP79F1 gene. In some embodiments, a deletion of a portion of a gene may be a portion of consecutive nucleotides that deleted from the 5' end and extends into the 3' end of the gene, optionally extending to the end of the gene or coding sequence. In some embodiments, a deletion of a portion of a gene encoding a myrosinase protein, an AOP2 protein or a CYP79F1 protein may comprise a deletion of a portion of at least 3 consecutive nucleotides to up to the entire gene. In some embodiments, a deletion of a portion of a gene encoding a myrosinase protein, a gene encoding an AOP2 protein or a gene encoding a CYP79F1 protein may result in the production of no protein or may result in the production of a protein (e.g., a peptide) that is non-functional.

In some embodiments, a deletion of a portion of a myrosinase gene may comprise deletion of a portion of consecutive nucleotides as described herein from a nucleotide sequence having at least 80% sequence identity to the nucleotide sequence of any one of SEQ ID NOs: 66-92, or 680-721. In some embodiments, a deletion of a portion of an AOP2 gene may comprise deletion of a portion of consecutive nucleotides as described herein from a nucleotide sequence having at least 80% sequence identity to the nucleotide sequence of any one of SEQ ID NOs: 118-127 or 722-736. In some embodiments, a deletion of a portion of a CYP79F1 gene may comprise deletion of a portion of consecutive nucleotides as described herein from a nucleotide sequence having at least 80% sequence identity to the nucleotide sequence of SEQ ID NOs: 113, 114, or 737-742. In some embodiments, a deletion of a portion of nucleotides from a nucleotide sequence having at least 80% sequence identity to any one of the nucleotide sequences of SEQ ID NOs: 66-92 or 668-721, SEQ ID NOs: 118-127 or 722-736, or SEQ ID NOs: 113, 114, or 737-742 may result in the truncation of the encoded protein and the production of no protein or the production of a protein that is non-functional.

In some embodiments, such a deletion in myrosinase gene (i.e., glucosinolase, thioglucosidase (e.g., β-thioglucosidase), thioglucoside glucohydrolase; EC 3.2.1.147 (EC 3.2.3.1 transferred to 3.2.1.147)), an AOP2 gene (i.e., a 2-oxo acid-dependent dioxygenase; EC 1.14.11.M8), and/or a CYP79F1 gene (i.e., a cytochrome P450 mono-oxygenase, homomethionine N-monooxygenase; EC 1.14.14.42) gene may result in a null allele, which when comprised in a plant can result in a phenotype of reduced pungency and/or reduced bitterness as compared to a plant not comprising the edit and grown under the same environmental conditions. In some embodiments, such a deletion may be a dominant-negative allele, semi-dominant allele, weak loss of function allele, a null allele, or a hypomorphic mutation, which when comprised in a plant can result in in a phenotype of reduced pungency and/or reduced bitterness.

Similarly, a portion of a polypeptide may be 4 amino acids, 5 amino acids, 6 amino acids, 7 amino acids, and so on, going up to the full length polypeptide. The length of the portion to be used or deleted will depend on the particular application. A portion of a polypeptide useful as an epitope may be as short as 4 amino acids. A portion of a polypeptide that performs the function of the full-length polypeptide would generally be longer than 4 amino acids. In some embodiments, a fragment of a polypeptide or polynucleotide comprises at least 10%, 20%, 30%, 40%, 50%, 60%, 70%, 80%, 90%, 95%, 96%, 97%, 98%, or 99% of the entire length of the reference polypeptide or polynucleotide.

Further, with respect to polypeptides, the term "fragment" or "portion" may refer to a polypeptide that is reduced in length relative to a reference polypeptide and that comprises, consists essentially of and/or consists of an amino acid sequence of contiguous amino acids identical or almost identical (e.g., 90%, 91%, 92%, 93%, 94%, 95%, 96%, 97%, 98%, 99% identical) to a corresponding portion of the reference polypeptide. Such a polypeptide fragment may be, where appropriate, included in a larger polypeptide of which it is a constituent. In some embodiments, the polypeptide fragment comprises, consists essentially of or consists of at least about 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 300, 350, 400 or more consecutive amino acids of a reference polypeptide. In some embodiments, a myrosinase polypeptide, an AOP2 polypeptide and/or a CYP79F1 polypeptide may be reduced in length by about 5, 6, 7, 8, 9, 10, 11, 12, 13, 14, 15, 20, 25, 30, 35, 40, 45, 50, 55, 60, 65, 70, 75, 80, 85, 90, 95, 100, 110, 115, 120, 125, 130, 135, 140, 145, 150, 155, 160, 165, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 500, 510, 520, 530, or 540 or more consecutive amino acid residues (or any range or value therein). In some embodiments, a myrosinase polypeptide, an AOP2 polypeptide and/or a CYP79F1 polypeptide may be reduced in length may be so reduced in length that it cannot be detected (e.g., is absent) or that the portion remaining is non-functional. In some embodiments, such a polypeptide having a reduced length as described herein may be a dominant-negative allele, semi-dominant allele, weak loss of function allele, a null allele, or a hypomorphic mutation, which when comprised in a plant, results in a plant that exhibits reduced pungency and/or reduced bitterness compared to a plant not comprising the mutation and grown under the same environmental conditions.

In some embodiments, a polypeptide having at least 80% sequence identity to any one of the amino acid sequences of SEQ ID NOs: 93-105, 115, 128-132, 617-679 or 743-786 may be reduced in length by about 5 to about 540 or more consecutive amino acid residues (or any range or value therein) up to the full length of the polypeptide. In some embodiments, the polypeptide may be so reduced in length that it cannot be detected (e.g., is absent) or that the portion remaining is non-functional.

In some embodiments, a "portion" may be related to the number of amino acids that are deleted from a polypeptide. Thus, for example, a deleted "portion" of, for example, a myrosinase polypeptide (i.e., glucosinolase, thioglucosidase (e.g., β-thioglucosidase), thioglucoside glucohydrolase; EC 3.2.1.147 (EC 3.2.3.1 transferred to 3.2.1.147)), an AOP2 polypeptide (i.e., a 2-oxo acid-dependent dioxygenase; EC 1.14.11.M8) and/or a CYP79F1 polypeptide (i.e., a cytochrome P450 mono-oxygenase, homomethionine N-monooxygenase; EC 1.14.14.42) may comprise at least one amino acid residue (e.g., at least 1, or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 110, 115, 120, 125, 130, 135, 140, 145, 150, 155, 160, 165, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 500, 510, 520, 530, or 540 or more consecutive amino acid residues (or any range or value therein). In some embodiments, a portion of amino acids may be deleted from a polypeptide having at least 80% sequence identity to any one of SEQ ID NOs: 93-105, 115, 128-132, 617-679 or 743-786. In some embodiments, a deletion of a portion of a myrosinase polypeptide, an AOP2 polypeptide and/or a CYP79F1 polypeptide may comprise a deletion of a portion of consecutive amino acid residues from the N- or C-terminus of a polypeptide, within a polypeptide, or from the N-terminus through to the end of the C terminus of a polypeptide having at least 80% sequence identity to any one of SEQ ID NOs: 93-105, 115, 128-132, 617-679 or 743-786. In some embodiments, such a deletion may be a dominant-negative allele, semi-dominant allele, weak loss of function allele, a null allele, or a hypomorphic mutation, which when comprised in a plant, the plant exhibits reduced pungency and/or reduced bitterness compared to a plant not comprising the mutation and grown under the same environmental conditions. In some embodiments, such a deletion is a null allele, which when comprised in a plant, the plant exhibits reduced pungency and/or reduced bitterness compared to a plant not comprising the mutation and grown under the same environmental conditions.

As used herein, the term "gene" refers to any segment of DNA associated with a biological function. Thus, genes include, but are not limited to, coding sequences and/or the regulatory sequences required for their expression. Genes can also include non-expressed DNA segments that, for example, form recognition sequences for other proteins. Genes can be obtained from a variety of sources, including cloning from a source of interest or synthesizing from known or predicted sequence information, and may include sequences designed to have desired parameters.

As used herein, the term "endogenous" or "endogenous gene," refers to the naturally occurring gene, in the location in which it is naturally found within the host cell genome. An endogenous gene as described herein can include alleles of naturally occurring genes that have been mutated according to any of the methods of the present disclosure, i.e., an endogenous gene may have been modified previously by traditional plant breeding methods and/or next generation plant breeding methods.

As used herein, the term "exogenous" refers to a substance coming from some source other than its native source or location. For example, the terms "exogenous protein," or "exogenous gene" or "exogenous nucleic acid" refer to a protein or nucleic acid from a non-native source, and that has been artificially supplied to a biological system.

A "heterologous" or a "recombinant" nucleotide sequence is a nucleotide sequence not naturally associated with a host cell into which it is introduced, including non-naturally occurring multiple copies of a naturally occurring nucleotide sequence. In some embodiments, the term "exogenous" is used interchangeably with the term "heterologous." In some embodiments, the term "heterologous nucleic acid" refers to a nucleic acid sequence that is not naturally found in the particular organism. For example, the term "heterologous promoter" may refer to a promoter that has been taken from one source organism and utilized in another organism, in which the promoter is not naturally found. However, the term "heterologous promoter" may also refer to a promoter that is from within the same source organism, but has been moved to a novel location, in which said promoter is not normally located.

Heterologous gene sequences can be introduced into a target cell by using an "expression vector," which can be a eukaryotic expression vector, for example a plant expression vector. Methods used to construct vectors are well known to a person skilled in the art and described in various publications. In particular, techniques for constructing suitable vectors, including a description of the functional components such as promoters, enhancers, termination and polyadenylation signals, selection markers, origins of replication, and splicing signals, are reviewed in the prior art.

As used herein, the term "homologous" or "homolog" or "ortholog" is known in the art and refers to related sequences that share a common ancestor or family member and are determined based on the degree of sequence identity. Homologous sequences are orthologous when they are inferred to be descended from the same ancestral sequence separated by a speciation event: when a species diverges into two separate species, the copies of a single gene in the two resulting species are said to be orthologous. "Orthologs", or "orthologous genes," are genes in different species that originated by vertical descent from a single gene of the last common ancestor. The terms "homology," "homologous," "substantially similar" and "corresponding substantially" are used interchangeably herein. They refer to nucleic acid fragments wherein changes in one or more nucleotide bases do not affect the ability of the nucleic acid fragment to mediate gene expression or produce a certain phenotype. These terms also refer to modifications of the nucleic acid fragments of the instant disclosure such as deletion or insertion of one or more nucleotides that do not substantially alter the functional properties of the resulting nucleic acid fragment relative to the initial, unmodified fragment. It is therefore understood, as those skilled in the art will appreciate, that the disclosure encompasses more than the specific exemplary sequences. These terms describe the relationship between a gene found in one species, subspecies, variety, cultivar or strain and the corresponding or equivalent gene in another species, subspecies, variety, cultivar or strain. For purposes of this disclosure, homologous sequences are compared. "Homologous sequences" or "homologs" or "orthologs" are thought, believed, or known to be functionally related. A functional relationship may be indicated in any one of a number of ways, including, but not limited to: (a) degree of sequence identity and/or (b) the same or similar biological function. Preferably, both (a) and (b) are indicated. Homology can be determined using software programs readily available in the art, such as those discussed in Current Protocols in Molecular Biology (F. M. Ausubel et al., eds., 1987) Supplement 30, section 7.718, Table 7.71. Some alignment programs are MacVector (Oxford Molecular Ltd, Oxford, U.K.), ALIGN Plus (Scientific and Educational Software, Pennsylvania) and AlignX (Vector NTI, Invitrogen, Carlsbad, CA). Another alignment program is Sequencher (Gene Codes, Ann Arbor, Michigan), using default parameters, and MUSCLE (Multiple Sequence Comparison by Log-Expection; a computer software licensed as public domain).

As used herein, the term "polynucleotide modification" refers to, e.g., base substitution, deletion, and/or insertion, as is well understood in the art. As used herein, the term "protein modification" refers to, e.g., amino acid modification, amino acid substitution, deletion, and/or insertion, as is well understood in the art.

As used herein, the term "codon optimization" refers to the codon usage of a DNA or RNA that is adapted to that of a cell or organism of interest to improve the transcription rate of said recombinant nucleic acid in the cell or organism of interest. The skilled person is well aware of the fact that a target nucleic acid can be modified at one position due to the codon degeneracy, whereas this modification will still lead to the same amino acid sequence at that position after translation, which is achieved by codon optimization to take into consideration the species-specific codon usage of a target cell or organism. In some embodiments, the polynucleotides, nucleic acid constructs, expression cassettes, and/or vectors of the editing systems of the invention (e.g., comprising/encoding a sequence-specific DNA binding domain (e.g., a sequence-specific DNA binding domain from a polynucleotide-guided endonuclease, a zinc finger nuclease, a transcription activator-like effector nuclease (TALEN), an Argonaute protein, and/or a CRISPR-Cas endonuclease (e.g., CRISPR-Cas effector protein) (e.g., a Type I CRISPR-Cas effector protein, a Type II CRISPR-Cas effector protein, a Type III CRISPR-Cas effector protein, a Type IV CRISPR-Cas effector protein, a Type V CRISPR-Cas effector protein or a Type VI CRISPR-Cas effector protein)), a nuclease (e.g., an endonuclease (e.g., FokI), a polynucleotide-guided endonuclease, a CRISPR-Cas endonuclease (e.g., CRISPR-Cas effector protein), a zinc finger nuclease, and/or a transcription activator-like effector nuclease (TALEN)), deaminase proteins/domains (e.g., adenine deaminase, cytosine deaminase), a polynucleotide encoding a reverse transcriptase protein or domain, a polynucleotide encoding a 5'-3' exonuclease polypeptide, and/or affinity polypeptides, peptide tags, etc.) may be codon optimized for expression in a plant. In some embodiments, codon optimized nucleic acids, polynucleotides, expression cassettes, and/or vectors of the invention have about 70% to about 99.9% (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%. 99.9% or 100%) identity or more to the reference nucleic acids, polynucleotides, expression cassettes, and/or vectors that have not been codon optimized.

As used herein, the term "naturally occurring" as applied to a nucleic acid, a polypeptide, a cell, or an organism, refers to a nucleic acid, polypeptide, cell, or organism that is found in nature. The term "naturally occurring" may refer to a gene, polynucleotide, or polypeptide derived from a naturally occurring source. Thus, for the purposes of this disclosure, a "non-natural" or a "non-naturally occurring" sequence is a sequence that has been synthesized, mutated, engineered, edited, or otherwise modified to have a different sequence from known natural sequences. In some embodiments, the modification may be at the protein level (e.g., amino acid modifications, e.g., substitutions, deletions, or additions/insertions). In other embodiments, the modification may be at the DNA level (e.g., nucleotide or base modifications, e.g., substitutions, deletions, or insertions). "Non-natural" refers to a nucleic acid, a polypeptide, a cell, or an organism, that is not found in nature (e.g., a non-natural mutation) or not found in nature in the specific combination described.

The term "mutation" refers to point mutations (e.g., missense, or nonsense, or insertions or deletions of single base pairs that result in frame shifts), insertions, deletions, and/or truncations. When the mutation is a substitution of a residue within an amino acid sequence with another residue, or a deletion or insertion of one or more residues within a sequence, the mutations are typically described by identifying the original residue followed by the position of the residue within the sequence and by the identity of the newly substituted residue. A truncation can include a truncation at the C-terminal end of a polypeptide or at the N-terminal end of a polypeptide or may be a truncation that extends from the N-terminus through to the end of the C-terminus. A truncation of a polypeptide can be the result of a deletion of the corresponding 5' end or 3' end of the gene encoding the polypeptide or may be a deletion of most or all of the 5' end of the gene through the 3' end of the gene encoding the polypeptide. In some embodiments, a truncation of a myrosinase gene, an AOP2 gene and/or a CYP79F1 gene may be a mutation such as a base deletion, addition, or substitution that results in an in-frame mutation or an out-of-frame mutation. In some embodiments, a truncation of a myrosinase gene, an AOP2 gene and/or a CYP79F1 gene may be a mutation that results in premature stop codon, thereby producing a truncation of the encoded polypeptide.

As used herein, the phrases "recombinant construct", "expression construct", "chimeric construct", "heterologous construct", and "recombinant DNA construct" are used interchangeably herein. A recombinant construct comprises an artificial combination of nucleic acid fragments, e.g., regulatory and coding sequences that are not found together in nature. For example, a chimeric construct may comprise regulatory sequences and coding sequences that are derived from different sources, or regulatory sequences and coding sequences derived from the same source, but arranged in a manner different than that found in nature. Such construct may be used by itself or may be used in conjunction with a vector. If a vector is used then the choice of vector is dependent upon the method that will be used to transform host cells as is well known to those skilled in the art. For example, a plasmid vector can be used. The skilled artisan is well aware of the genetic elements that must be present on the vector in order to successfully transform, select and propagate host cells comprising any of the isolated nucleic acid fragments of the disclosure. The skilled artisan will also recognize that different independent transformation events will result in different levels and patterns of expression (Jones et al., (1985) EMBO J. 4:2411-2418; De Almeida et al., (1989) Mol. Gen. Genetics 218:78-86), and thus that multiple events must be screened in order to obtain lines displaying the desired expression level and pattern. Such screening may be accomplished by Southern analysis of DNA, Northern analysis of mRNA expression, immunoblotting analysis of protein expression, or phenotypic analysis, among others. Vectors can be plasmids, viruses, bacteriophages, pro-viruses, phagemids, transposons, artificial chromosomes, and the like, that replicate autonomously or can integrate into a chromosome of a host cell. A vector can also be a naked RNA polynucleotide, a naked DNA polynucleotide, a polynucleotide composed of both DNA and RNA within the same strand, a poly-lysine-conjugated DNA or RNA, a peptide-conjugated DNA or RNA, a liposome-conjugated DNA, or the like, that is not autonomously replicating. As used herein, the term "expression" refers to the production of a functional end-product e.g., an mRNA or a protein (precursor or mature).

In any of the embodiments described herein, a polynucleotide or nucleic acid construct of the invention may be operatively associated with a variety of promoters and/or other regulatory elements for expression in a plant and/or a cell of a plant. Thus, in some embodiments, a polynucleotide or nucleic acid construct of this invention may further comprise one or more promoters, introns, enhancers, and/or terminators operably linked to one or more nucleotide sequences. In some embodiments, a promoter may be operably associated with an intron (e.g., Ubi1 promoter and intron). In some embodiments, a promoter associated with an intron maybe referred to as a "promoter region" (e.g., Ubi1 promoter and intron).

By "operably linked" or "operably associated" as used herein in reference to polynucleotides, it is meant that the indicated elements are functionally related to each other, and are also generally physically related. Thus, the term "operably linked" or "operably associated" as used herein, refers to nucleotide sequences on a single nucleic acid molecule that are functionally associated. Thus, a first nucleotide sequence that is operably linked to a second nucleotide sequence means a situation when the first nucleotide sequence is placed in a functional relationship with the second nucleotide sequence. For instance, a promoter is operably associated with a nucleotide sequence if the promoter effects the transcription or expression of said nucleotide sequence. Those skilled in the art will appreciate that the control sequences (e.g., promoter) need not be contiguous with the nucleotide sequence to which it is operably associated, as long as the control sequences function to direct the expression thereof. Thus, for example, intervening untranslated, yet transcribed, nucleic acid sequences can be present between a promoter and the nucleotide sequence, and the promoter can still be considered "operably linked" to the nucleotide sequence.

As used herein, the term "linked," in reference to polypeptides, refers to the attachment of one polypeptide to another. A polypeptide may be linked to another polypeptide (at the N-terminus or the C-terminus) directly (e.g., via a peptide bond) or through a linker.

The term "linker" is art-recognized and refers to a chemical group, or a molecule linking two molecules or moieties, e.g., two domains of a fusion protein, such as, for example, a DNA binding polypeptide or domain and peptide tag and/or a reverse transcriptase and an affinity polypeptide that binds to the peptide tag; or a DNA endonuclease polypeptide or domain and peptide tag and/or a reverse transcriptase and an affinity polypeptide that binds to the peptide tag. A linker may be comprised of a single linking molecule or may comprise more than one linking molecule. In some embodiments, the linker can be an organic molecule, group, polymer, or chemical moiety such as a bivalent organic moiety. In some embodiments, the linker may be an amino acid or it may be a peptide. In some embodiments, the linker is a peptide.

In some embodiments, a peptide linker useful with this invention may be about 2 to about 100 or more amino acids in length, for example, about 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length (e.g., about 2 to about 40, about 2 to about 50, about 2 to about 60, about 4 to about 40, about 4 to about 50, about 4 to about 60, about 5 to about 40, about 5 to about 50, about 5 to about 60, about 9 to about 40, about 9 to about 50, about 9 to about 60, about 10 to about 40, about 10 to about 50, about 10 to about 60, or about 2, 3, 4, 5, 6, 7, 8, 9, 10, 11, 12, 13, 14, 15, 16, 17, 18, 19, 20, 21, 22, 23, 24, 25 amino acids to about 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length (e.g., about 105, 110, 115, 120, 130, 140 150 or more amino acids in length). In some embodiments, a peptide linker may be a GS linker.

As used herein, the term "linked," or "fused" in reference to polynucleotides, refers to the attachment of one polynucleotide to another. In some embodiments, two or more polynucleotide molecules may be linked by a linker that can be an organic molecule, group, polymer, or chemical moiety such as a bivalent organic moiety. A polynucleotide may be linked or fused to another polynucleotide (at the 5' end or the 3' end) via a covalent or non-covenant linkage or binding, including e.g., Watson-Crick base-pairing, or through one or more linking nucleotides. In some embodiments, a polynucleotide motif of a certain structure may be inserted within another polynucleotide sequence (e.g. extension of the hairpin structure in the guide RNA). In some embodiments, the linking nucleotides may be naturally occurring nucleotides. In some embodiments, the linking nucleotides may be non-naturally occurring nucleotides.

A "promoter" is a nucleotide sequence that controls or regulates the transcription of a nucleotide sequence (e.g., a coding sequence) that is operably associated with the promoter. The coding sequence controlled or regulated by a promoter may encode a polypeptide and/or a functional RNA. Typically, a "promoter" refers to a nucleotide sequence that contains a binding site for RNA polymerase II and directs the initiation of transcription. In general, promoters are found 5', or upstream, relative to the start of the coding region of the corresponding coding sequence. A promoter may comprise other elements that act as regulators of gene expression; e.g., a promoter region. These include a TATA box consensus sequence, and often a CAAT box consensus sequence (Breathnach and Chambon, (1981) *Annu. Rev. Biochem.* 50:349). In plants, the CAAT box may be substituted by the AGGA box (Messing et al., (1983) in *Genetic Engineering of Plants*, T. Kosuge, C. Meredith and A. Hollaender (eds.), Plenum Press, pp. 211-227).

Promoters useful with this invention can include, for example, constitutive, inducible, temporally regulated, developmentally regulated, chemically regulated, tissue-preferred and/or tissue-specific promoters for use in the preparation of recombinant nucleic acid molecules, e.g., "synthetic nucleic acid constructs" or "protein-RNA complex." These various types of promoters are known in the art.

The choice of promoter may vary depending on the temporal and spatial requirements for expression, and also may vary based on the host cell to be transformed. Promoters for many different organisms are well known in the art. Based on the extensive knowledge present in the art, the appropriate promoter can be selected for the particular host organism of interest. Thus, for example, much is known about promoters upstream of highly constitutively expressed genes in model organisms and such knowledge can be readily accessed and implemented in other systems as appropriate.

In some embodiments, a promoter functional in a plant may be used with the constructs of this invention. Non-limiting examples of a promoter useful for driving expression in a plant include the promoter of the RubisCo small subunit gene 1 (PrbcS1), the promoter of the actin gene (Pactin), the promoter of the nitrate reductase gene (Pnr) and the promoter of duplicated carbonic anhydrase gene 1 (Pdca1) (See, Walker et al. *Plant Cell Rep.* 23:727-735 (2005); Li et al. *Gene* 403:132-142 (2007); Li et al. *Mol Biol. Rep.* 37:1143-1154 (2010)). PrbcS1 and Pactin are constitutive promoters and Pnr and Pdca1 are inducible promoters. Pnr is induced by nitrate and repressed by ammonium (Li et al. *Gene* 403:132-142 (2007)) and Pdca1 is induced by salt (Li et al. *Mol Biol. Rep.* 37:1143-1154 (2010)). In some embodiments, a promoter useful with this invention is RNA polymerase II (Pol II) promoter. In some embodiments, a U6 promoter or a 7SL promoter from *Zea mays* may be useful with constructs of this invention. In some embodiments, the U6c promoter and/or 7SL promoter from *Zea mays* may be useful for driving expression of a guide nucleic acid. In some embodiments, a U6c promoter, U6i promoter and/or 7SL promoter from *Glycine max* may be useful with constructs of this invention. In some embodiments, the U6c promoter, U6i promoter and/or 7SL promoter from *Glycine max* may be useful for driving expression of a guide nucleic acid.

Examples of constitutive promoters useful for plants include, but are not limited to, cestrum virus promoter (cmp) (U.S. Pat. No. 7,166,770), the rice actin 1 promoter (Wang et al. (1992) *Mol. Cell. Biol.* 12:3399-3406; as well as U.S. Pat. No. 5,641,876), CaMV 35S promoter (Odell et al. (1985) *Nature* 313:810-812), CaMV 19S promoter (Lawton et al. (1987) *Plant Mol. Biol.* 9:315-324), nos promoter (Ebert et al. (1987) *Proc. Natl. Acad. Sci USA* 84:5745-5749), Adh promoter (Walker et al. (1987) *Proc. Natl. Acad.*

Sci. USA 84:6624-6629), sucrose synthase promoter (Yang & Russell (1990) Proc. Natl. Acad. Sci. USA 87:4144-4148), and the ubiquitin promoter. The constitutive promoter derived from ubiquitin accumulates in many cell types. Ubiquitin promoters have been cloned from several plant species for use in transgenic plants, for example, sunflower (Binet et al., 1991. Plant Science 79:87-94), maize (Christensen et al., 1989. Plant Molec. Biol. 12:619-632), and arabidopsis (Norris et al. 1993. Plant Molec. Biol. 21:895-906). The maize ubiquitin promoter (UbiP) has been developed in transgenic monocot systems and its sequence and vectors constructed for monocot transformation are disclosed in the patent publication EP 0 342 926. The ubiquitin promoter is suitable for the expression of the nucleotide sequences of the invention in transgenic plants, especially monocotyledons. Further, the promoter expression cassettes described by McElroy et al. (Mol. Gen. Genet. 231:150-160 (1991)) can be easily modified for the expression of the nucleotide sequences of the invention and are particularly suitable for use in monocotyledonous hosts.

In some embodiments, tissue specific/tissue preferred promoters can be used for expression of a heterologous polynucleotide in a plant cell. Tissue specific or preferred expression patterns include, but are not limited to, green tissue specific or preferred, root specific or preferred, stem specific or preferred, flower specific or preferred or pollen specific or preferred. Promoters suitable for expression in green tissue include many that regulate genes involved in photosynthesis and many of these have been cloned from both monocotyledons and dicotyledons. In one embodiment, a promoter useful with the invention is the maize PEPC promoter from the phosphoenol carboxylase gene (Hudspeth & Grula, Plant Molec. Biol. 12:579-589 (1989)). Non-limiting examples of tissue-specific promoters include those associated with genes encoding the seed storage proteins (such as β-conglycinin, cruciferin, napin and phaseolin), zein or oil body proteins (such as oleosin), or proteins involved in fatty acid biosynthesis (including acyl carrier protein, stearoyl-ACP desaturase and fatty acid desaturases (fad 2-1)), and other nucleic acids expressed during embryo development (such as Bce4, see, e.g., Kridl et al. (1991) Seed Sci. Res. 1:209-219; as well as EP U.S. Pat. No. 255,378). Tissue-specific or tissue-preferential promoters useful for the expression of the nucleotide sequences of the invention in plants, particularly maize, include but are not limited to those that direct expression in root, pith, leaf or pollen. Such promoters are disclosed, for example, in WO 93/07278, herein incorporated by reference in its entirety. Other non-limiting examples of tissue specific or tissue preferred promoters useful with the invention the cotton rubisco promoter disclosed in U.S. Pat. No. 6,040,504; the rice sucrose synthase promoter disclosed in U.S. Pat. No. 5,604,121; the root specific promoter described by de Framond (FEBS 290:103-106 (1991); EP 0 452 269 to Ciba-Geigy); the stem specific promoter described in U.S. Pat. No. 5,625,136 (to Ciba-Geigy) and which drives expression of the maize trpA gene; the cestrum yellow leaf curling virus promoter disclosed in WO 01/73087; and pollen specific or preferred promoters including, but not limited to, ProOsLPS10 and ProOsLPS11 from rice (Nguyen et al. Plant Biotechnol. Reports 9 (5): 297-306 (2015)), ZmSTK2_USP from maize (Wang et al. Genome 60 (6): 485-495 (2017)), LAT52 and LAT59 from tomato (Twell et al. Development 109 (3): 705-713 (1990)), Zm13 (U.S. Pat. No. 10,421,972), PLA2-promoter from arabidopsis (U.S. Pat. No. 7,141,424), and/or the ZmC5 promoter from maize (International PCT Publication No. WO1999/042587.

Additional examples of plant tissue-specific/tissue preferred promoters include, but are not limited to, the root hair-specific cis-elements (RHEs) (Kim et al. The Plant Cell 18:2958-2970 (2006)), the root-specific promoters RCc3 (Jeong et al. Plant Physiol. 153:185-197 (2010)) and RB7 (U.S. Pat. No. 5,459,252), the lectin promoter (Lindstrom et al. (1990) Der. Genet. 11:160-167; and Vodkin (1983) Prog. Clin. Biol. Res. 138:87-98), corn alcohol dehydrogenase 1 promoter (Dennis et al. (1984) Nucleic Acids Res. 12:3983-4000), S-adenosyl-L-methionine synthetase (SAMS) (Vander Mijnsbrugge et al. (1996) Plant and Cell Physiology, 37 (8): 1108-1115), corn light harvesting complex promoter (Bansal et al. (1992) Proc. Natl. Acad. Sci. USA 89:3654-3658), corn heat shock protein promoter (O'Dell et al. (1985) EMBO J. 5:451-458; and Rochester et al. (1986) EMBO J. 5:451-458), pea small subunit RuBP carboxylase promoter (Cashmore, "Nuclear genes encoding the small subunit of ribulose-1,5-bisphosphate carboxylase" pp. 29-39 In: Genetic Engineering of Plants (Hollaender ed., Plenum Press 1983; and Poulsen et al. (1986) Mol. Gen. Genet. 205:193-200), Ti plasmid mannopine synthase promoter (Langridge et al. (1989) Proc. Natl. Acad. Sci. USA 86:3219-3223), Ti plasmid nopaline synthase promoter (Langridge et al. (1989), supra), petunia chalcone isomerase promoter (van Tunen et al. (1988) EMBO J. 7:1257-1263), bean glycine rich protein 1 promoter (Keller et al. (1989) Genes Dev. 3:1639-1646), truncated CaMV 35S promoter (O'Dell et al. (1985) Nature 313:810-812), potato patatin promoter (Wenzler et al. (1989) Plant Mol. Biol. 13:347-354), root cell promoter (Yamamoto et al. (1990) Nucleic Acids Res. 18:7449), maize zein promoter (Kriz et al. (1987) Mol. Gen. Genet. 207:90-98; Langridge et al. (1983) Cell 34:1015-1022; Reina et al. (1990) Nucleic Acids Res. 18:6425; Reina et al. (1990) Nucleic Acids Res. 18:7449; and Wandelt et al. (1989) Nucleic Acids Res. 17:2354), globulin-1 promoter (Belanger et al. (1991) Genetics 129:863-872), α-tubulin cab promoter (Sullivan et al. (1989) Mol. Gen. Genet. 215:431-440), PEPCase promoter (Hudspeth & Grula (1989) Plant Mol. Biol. 12:579-589), R gene complex-associated promoters (Chandler et al. (1989) Plant Cell 1:1175-1183), and chalcone synthase promoters (Franken et al. (1991) EMBO J. 10:2605-2612).

Useful for seed-specific expression is the pea vicilin promoter (Czako et al. (1992) Mol. Gen. Genet. 235:33-40; as well as the seed-specific promoters disclosed in U.S. Pat. No. 5,625,136. Useful promoters for expression in mature leaves are those that are switched at the onset of senescence, such as the SAG promoter from Arabidopsis (Gan et al. (1995) Science 270:1986-1988).

In addition, promoters functional in chloroplasts can be used. Non-limiting examples of such promoters include the bacteriophage T3 gene 9 5' UTR and other promoters disclosed in U.S. Pat. No. 7,579,516. Other promoters useful with the invention include but are not limited to the S-E9 small subunit RuBP carboxylase promoter and the Kunitz trypsin inhibitor gene promoter (Kti3).

Additional regulatory elements useful with this invention include, but are not limited to, introns, enhancers, termination sequences and/or 5' and 3' untranslated regions.

An intron useful with this invention can be an intron identified in and isolated from a plant and then inserted into an expression cassette to be used in transformation of a plant. As would be understood by those of skill in the art, introns can comprise the sequences required for self-excision and are incorporated into nucleic acid constructs/expression cassettes in frame. An intron can be used either as a spacer to separate multiple protein-coding sequences in one nucleic acid construct, or an intron can be used inside one protein-coding sequence to, for example, stabilize the mRNA. If they are used within a protein-coding sequence, they are inserted "in-frame" with the excision sites included. Introns may also be associated with promoters to improve or modify expression. As an example, a promoter/intron combination useful with this invention includes but is not limited to that of the maize Ubi1 promoter and intron (see, e.g. SEQ ID NO:21 and SEQ ID NO:22).

Non-limiting examples of introns useful with the present invention include introns from the ADHI gene (e.g., Adh1-S introns 1, 2 and 6), the ubiquitin gene (Ubi1), the RuBisCO small subunit (rbcS) gene, the RuBisCO large subunit (rbcL) gene, the actin gene (e.g., actin-1 intron), the pyruvate dehydrogenase kinase gene (pdk), the nitrate reductase gene (nr), the duplicated carbonic anhydrase gene 1 (Tdca1), the psbA gene, the atpA gene, or any combination thereof.

In some embodiments, a polynucleotide and/or a nucleic acid construct of the invention can be an "expression cassette" or can be comprised within an expression cassette. As used herein, "expression cassette" means a recombinant nucleic acid molecule comprising, for example, a one or more polynucleotides of the invention (e.g., a polynucleotide encoding a sequence-specific DNA binding domain, a polynucleotide encoding a deaminase protein or domain, a polynucleotide encoding a reverse transcriptase protein or domain, a polynucleotide encoding a 5'-3' exonuclease polypeptide or domain, a guide nucleic acid and/or reverse transcriptase (RT) template), wherein polynucleotide(s) is/are operably associated with one or more control sequences (e.g., a promoter, terminator and the like). Thus, in some embodiments, one or more expression cassettes may be provided, which are designed to express, for example, a nucleic acid construct of the invention (e.g., a polynucleotide encoding a sequence-specific DNA binding domain, a polynucleotide encoding a nuclease polypeptide/domain, a polynucleotide encoding a deaminase protein/domain, a polynucleotide encoding a reverse transcriptase protein/domain, a polynucleotide encoding a 5'-3' exonuclease polypeptide/domain, a polynucleotide encoding a peptide tag, and/or a polynucleotide encoding an affinity polypeptide, and the like, or comprising a guide nucleic acid, an extended guide nucleic acid, and/or RT template, and the like). When an expression cassette of the present invention comprises more than one polynucleotide, the polynucleotides may be operably linked to a single promoter that drives expression of all of the polynucleotides or the polynucleotides may be operably linked to one or more separate promoters (e.g., three polynucleotides may be driven by one, two or three promoters in any combination). When two or more separate promoters are used, the promoters may be the same promoter or they may be different promoters. Thus, a polynucleotide encoding a sequence specific DNA binding domain, a polynucleotide encoding a nuclease protein/domain, a polynucleotide encoding a CRISPR-Cas effector protein/domain, a polynucleotide encoding an deaminase protein/domain, a polynucleotide encoding a reverse transcriptase polypeptide/domain (e.g., RNA-dependent DNA polymerase), and/or a polynucleotide encoding a 5'-3' exonuclease polypeptide/domain, a guide nucleic acid, an extended guide nucleic acid and/or RT template when comprised in a single expression cassette may each be operably linked to a single promoter, or separate promoters in any combination.

An expression cassette comprising a nucleic acid construct of the invention may be chimeric, meaning that at least one of its components is heterologous with respect to at least one of its other components (e.g., a promoter from the host organism operably linked to a polynucleotide of interest to be expressed in the host organism, wherein the polynucleotide of interest is from a different organism than the host or is not normally found in association with that promoter). An expression cassette may also be one that is naturally occurring but has been obtained in a recombinant form useful for heterologous expression.

An expression cassette can optionally include a transcriptional and/or translational termination region (i.e., termination region) and/or an enhancer region that is functional in the selected host cell. A variety of transcriptional terminators and enhancers are known in the art and are available for use in expression cassettes. Transcriptional terminators are responsible for the termination of transcription and correct mRNA polyadenylation. A termination region and/or the enhancer region may be native to the transcriptional initiation region, may be native to, for example, a gene encoding a sequence-specific DNA binding protein, a gene encoding a nuclease, a gene encoding a reverse transcriptase, a gene encoding a deaminase, and the like, or may be native to a host cell, or may be native to another source (e.g., foreign or heterologous to, for example, to a promoter, to a gene encoding a sequence-specific DNA binding protein, a gene encoding a nuclease, a gene encoding a reverse transcriptase, a gene encoding a deaminase, and the like, or to the host cell, or any combination thereof).

An expression cassette of the invention also can include a polynucleotide encoding a selectable marker, which can be used to select a transformed host cell. As used herein, "selectable marker" means a polynucleotide sequence that when expressed imparts a distinct phenotype to the host cell expressing the marker and thus allows such transformed cells to be distinguished from those that do not have the marker. Such a polynucleotide sequence may encode either a selectable or screenable marker, depending on whether the marker confers a trait that can be selected for by chemical means, such as by using a selective agent (e.g., an antibiotic and the like), or on whether the marker is simply a trait that one can identify through observation or testing, such as by screening (e.g., fluorescence). Many examples of suitable selectable markers are known in the art and can be used in the expression cassettes described herein.

In addition to expression cassettes, the nucleic acid molecules/constructs and polynucleotide sequences described herein can be used in connection with vectors. The term "vector" refers to a composition for transferring, delivering or introducing a nucleic acid (or nucleic acids) into a cell. A vector comprises a nucleic acid construct (e.g. expression cassette(s)) comprising the nucleotide sequence(s) to be transferred, delivered or introduced. Vectors for use in transformation of host organisms are well known in the art. Non-limiting examples of general classes of vectors include viral vectors, plasmid vectors, phage vectors, phagemid vectors, cosmid vectors, fosmid vectors, bacteriophages, artificial chromosomes, minicircles, or *Agrobacterium* binary vectors in double or single stranded linear or circular form which may or may not be self-transmissible or mobilizable. In some embodiments, a viral vector can include, but is not limited to, a retroviral, lentiviral, adenoviral, adeno-associated, or herpes simplex viral vector. A vector as defined herein can transform a prokaryotic or eukaryotic host either by integration into the cellular genome or exist extrachromosomally (e.g. autonomous replicating plasmid with an origin of replication). Additionally included are shuttle vectors by which is meant a DNA vehicle capable, naturally or by design, of replication in two different host organisms, which may be selected from actinomycetes and related species, bacteria and eukaryotic (e.g. higher plant, mammalian, yeast or fungal cells). In some embodiments, the nucleic acid in the vector is under the control of, and operably linked to, an appropriate promoter or other regulatory elements for transcription in a host cell. The vector may be a bi-functional expression vector which functions in multiple hosts. In the case of genomic DNA, this may contain its own promoter and/or other regulatory elements and in the case of cDNA this may be under the control of an appropriate promoter and/or other regulatory elements for expression in the host cell. A variety of eukaryotic expression vectors, containing a cloning site into which a polynucleotide can be operatively linked, are well known in the art and some are commercially available from companies such as Stratagene, La Jolla, Calif.; Invitrogen, Carlsbad, Calif.; Promega, Madison, Wis. or BD Biosciences Clontech, Palo Alto, Calif. In one embodiment, the expression vector comprises at least one nucleic acid sequence which is a regulatory sequence necessary for transcription and translation of nucleotide sequences that encode for a peptide/polypeptide/protein of interest. Accordingly, a nucleic acid or polynucleotide of this invention and/or expression cassettes comprising the same may be comprised in vectors as described herein and as known in the art.

As used herein, "contact," "contacting," "contacted," and grammatical variations thereof, refer to placing the components of a desired reaction together under conditions suitable for carrying out the desired reaction (e.g., transformation, transcriptional control, genome editing, nicking, and/or cleavage). As an example, a target nucleic acid may be contacted with a sequence-specific DNA binding protein (e.g., polynucleotide-guided endonuclease, a CRISPR-Cas endonuclease (e.g., CRISPR-Cas effector protein), a zinc finger nuclease, a transcription activator-like effector nuclease (TALEN) and/or an Argonaute protein)) and a deaminase or a nucleic acid construct encoding the same, under conditions whereby the sequence-specific DNA binding protein, the reverse transcriptase and/or the deaminase are expressed and the sequence-specific DNA binding protein binds to the target nucleic acid, and the reverse transcriptase and/or deaminase may be fused to either the sequence-specific DNA binding protein or recruited to the sequence-specific DNA binding protein (via, for example, a peptide tag fused to the sequence-specific DNA binding protein and an affinity tag fused to the reverse transcriptase and/or deaminase) and thus, the deaminase and/or reverse transcriptase is positioned in the vicinity of the target nucleic acid, thereby modifying the target nucleic acid. Other methods for recruiting reverse transcriptase and/or deaminase may be used that take advantage of other protein-protein interactions, and also RNA-protein interactions and chemical interactions may be used for protein-protein and protein-nucleic acid recruitment.

As used herein, "modifying" or "modification" in reference to a target nucleic acid includes editing (e.g., mutating), covalent modification, exchanging/substituting nucleic acids/nucleotide bases, deleting, cleaving, nicking, and/or altering transcriptional control of a target nucleic acid. In some embodiments, a modification may include one or more single base changes (SNPs) of any type.

"Introducing," "introduce," "introduced" (and grammatical variations thereof) in the context of a polynucleotide of interest means presenting a nucleotide sequence of interest (e.g., polynucleotide, RT template, a nucleic acid construct, and/or a guide nucleic acid) to a plant, plant part thereof, or cell thereof, in such a manner that the nucleotide sequence gains access to the interior of a cell.

The terms "transformation" or "transfection" may be used interchangeably and as used herein refer to the introduction of a heterologous nucleic acid into a cell. Transformation of a cell may be stable or transient. Thus, in some embodiments, a host cell or host organism (e.g., a plant) may be stably transformed with a polynucleotide/nucleic acid molecule of the invention. In some embodiments, a host cell or host organism may be transiently transformed with a polynucleotide/nucleic acid molecule of the invention.

"Transient transformation" in the context of a polynucleotide means that a polynucleotide is introduced into the cell and does not integrate into the genome of the cell.

By "stably introducing" or "stably introduced" in the context of a polynucleotide introduced into a cell is intended that the introduced polynucleotide is stably incorporated into the genome of the cell, and thus the cell is stably transformed with the polynucleotide.

"Stable transformation" or "stably transformed" as used herein means that a nucleic acid molecule is introduced into a cell and integrates into the genome of the cell. As such, the integrated nucleic acid molecule is capable of being inherited by the progeny thereof, more particularly, by the progeny of multiple successive generations. "Genome" as used herein includes the nuclear and the plastid genome, and therefore includes integration of the nucleic acid into, for example, the chloroplast or mitochondrial genome. Stable transformation as used herein can also refer to a transgene that is maintained extrachromasomally, for example, as a minichromosome or a plasmid.

Transient transformation may be detected by, for example, an enzyme-linked immunosorbent assay (ELISA) or Western blot, which can detect the presence of a peptide or polypeptide encoded by one or more transgene introduced into an organism. Stable transformation of a cell can be detected by, for example, a Southern blot hybridization assay of genomic DNA of the cell with nucleic acid sequences which specifically hybridize with a nucleotide sequence of a transgene introduced into an organism (e.g., a plant). Stable transformation of a cell can be detected by, for example, a Northern blot hybridization assay of RNA of the cell with nucleic acid sequences which specifically hybridize with a nucleotide sequence of a transgene introduced into a host organism. Stable transformation of a cell can also be detected by, e.g., a polymerase chain reaction (PCR) or other amplification reactions as are well known in the art, employing specific primer sequences that hybridize with target sequence(s) of a transgene, resulting in amplification of the transgene sequence, which can be detected according to standard methods Transformation can also be detected by direct sequencing and/or hybridization protocols well known in the art.

Accordingly, in some embodiments, nucleotide sequences, polynucleotides, nucleic acid constructs, and/or expression cassettes of the invention may be expressed transiently and/or they can be stably incorporated into the genome of the host organism. Thus, in some embodiments, a nucleic acid construct of the invention (e.g., one or more expression cassettes comprising polynucleotides for editing as described herein) may be transiently introduced into a cell with a guide nucleic acid and as such, no DNA is maintained in the cell. Thus, the term "transient" transformation refers to a way of introducing molecular tools including at least one nucleic acid (DNA, RNA, single-stranded or double-stranded or a mixture thereof) and/or at least one amino acid sequence, optionally comprising suitable chemical or biological agents, to achieve a transfer into at least one compartment of interest of a cell, including, but not restricted to, the cytoplasm, an organelle, including the nucleus, a mitochondrion, a vacuole, a chloroplast, or into a membrane, resulting in transcription and/or translation and/or association and/or activity of the at least one molecule introduced without achieving a stable integration or incorporation and thus inheritance of the respective at least one molecule introduced into the genome of a cell. The terms "transgene-free" refers to a condition that transgene is not present or found in the genome of a host cell or tissue or organism of interest.

A nucleic acid construct of the invention may be introduced into a plant cell by any method known to those of skill in the art. Non-limiting examples of transformation methods include transformation via bacterial-mediated nucleic acid delivery (e.g., via Agrobacteria), viral-mediated nucleic acid delivery, silicon carbide or nucleic acid whisker-mediated nucleic acid delivery, liposome mediated nucleic acid delivery, microinjection, microparticle bombardment, calcium-phosphate-mediated transformation, cyclodextrin-mediated transformation, electroporation, nanoparticle-mediated transformation, sonication, infiltration, PEG-mediated nucleic acid uptake, as well as any other electrical, chemical, physical (mechanical) and/or biological mechanism that results in the introduction of nucleic acid into the plant cell, including any combination thereof. Procedures for transforming both eukaryotic and prokaryotic organisms are well known and routine in the art and are described throughout the literature (See, for example, Jiang et al. 2013. *Nat. Biotechnol.* 31:233-239; Ran et al. *Nature Protocols* 8:2281-2308 (2013)). General guides to various plant transformation methods known in the art include Miki et al. ("Procedures for Introducing Foreign DNA into Plants" in *Methods in Plant Molecular Biology and Biotechnology*, Glick, B. R. and Thompson, J. E., Eds. (CRC Press, Inc., Boca Raton, 1993), pages 67-88) and Rakowoczy-Trojanowska (*Cell. Mol. Biol.* Lett. 7:849-858 (2002)).

In some embodiments of the invention, transformation of a cell may comprise nuclear transformation. In other embodiments, transformation of a cell may comprise plastid transformation (e.g., chloroplast transformation). In still further embodiments, nucleic acids of the invention may be introduced into a cell via conventional breeding techniques. In some embodiments, one or more of the polynucleotides, expression cassettes and/or vectors may be introduced into a plant cell via *Agrobacterium* transformation.

A polynucleotide therefore can be introduced into a plant, plant part, plant cell in any number of ways that are well known in the art. The methods of the invention do not depend on a particular method for introducing one or more nucleotide sequences into a plant, only that they gain access to the interior the cell. Where more than polynucleotide is to be introduced, they can be assembled as part of a single nucleic acid construct, or as separate nucleic acid constructs, and can be located on the same or different nucleic acid constructs. Accordingly, the polynucleotide can be introduced into the cell of interest in a single transformation event, or in separate transformation events, or, alternatively, a polynucleotide can be incorporated into a plant as part of a breeding protocol.

The term "sequence identity" refers to the percentage of bases or amino acids between two polynucleotide or polypeptide sequences that are the same, and in the same relative position. As such one polynucleotide or polypeptide sequence has a certain percentage of sequence identity compared to another polynucleotide or polypeptide sequence. For sequence comparison, typically one sequence acts as a reference sequence, to which test sequences are compared. The term "reference sequence" refers to a molecule to which a test sequence is compared. Identity can be readily calculated by known methods including, but not limited to, those described in: *Computational Molecular Biology* (Lesk, A. M., ed.) Oxford University Press, New York (1988); *Biocomputing: Informatics and Genome Projects* (Smith, D. W., ed.) Academic Press, New York (1993); *Computer Analysis of Sequence Data, Part I* (Griffin, A. M., and Griffin, H. G., eds.) Humana Press, New Jersey (1994); *Sequence Analysis in Molecular Biology* (von Heinje, G., ed.) Academic Press (1987); and *Sequence Analysis Primer* (Gribskov, M. and Devereux, J., eds.) Stockton Press, New York (1991).

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned. In some embodiments, "percent identity" can refer to the percentage of identical amino acids in an amino acid sequence as compared to a reference polypeptide.

As used herein, the phrase "substantially identical," or "substantial identity" in the context of two nucleic acid molecules, nucleotide sequences, or polypeptide sequences, refers to two or more sequences or subsequences that have at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% nucleotide or amino acid residue identity, when compared and aligned for maximum correspondence, as measured using one of the following sequence comparison algorithms or by visual inspection. In some embodiments of the invention, the substantial identity exists over a region of consecutive nucleotides of a nucleotide sequence of the invention that is about 10 nucleotides to about 20 nucleotides, about 10 nucleotides to about 25 nucleotides, about 10 nucleotides to about 30 nucleotides, about 15 nucleotides to about 25 nucleotides, about 30 nucleotides to about 40 nucleotides, about 50 nucleotides to about 60 nucleotides, about 70 nucleotides to about 80 nucleotides, about 90 nucleotides to about 100 nucleotides, about 100 nucleotides to about 200 nucleotides, about 100 nucleotides to about 300 nucleotides, about 100 nucleotides to about 400 nucleotides, about 100 nucleotides to about 500 nucleotides, about 100 nucleotides to about 600 nucleotides, about 100 nucleotides to about 800 nucleotides, about 100 nucleotides to about 900 nucleotides, or more in length, or any range therein, up to the full length of the sequence. In some embodiments, nucleotide sequences can be substantially identical over at least about 20 nucleotides (e.g., about 20, 21, 22, 23, 24, 25, 26, 27, 28, 29, 30, 31, 32, 33, 34, 35, 36, 37, 38, 39, 40, 50, 60, 70, 80, 90, 100, 150, 200, 300, 400, 500, 600, 700, 800, or 900 nucleotides or more).

In some embodiments of the invention, the substantial identity exists over a region of consecutive amino acid residues of a polypeptide of the invention that is about 3 amino acid residues to about 20 amino acid residues, about 5 amino acid residues to about 25 amino acid residues, about 7 amino acid residues to about 30 amino acid residues, about 10 amino acid residues to about 25 amino acid residues, about 15 amino acid residues to about 30 amino acid residues, about 20 amino acid residues to about 40 amino acid residues, about 25 amino acid residues to about 40 amino acid residues, about 25 amino acid residues to about 50 amino acid residues, about 30 amino acid residues to about 50 amino acid residues, about 40 amino acid residues to about 50 amino acid residues, about 40 amino acid residues to about 70 amino acid residues, about 50 amino acid residues to about 70 amino acid residues, about 60 amino acid residues to about 80 amino acid residues, about 70 amino acid residues to about 80 amino acid residues, about 90 amino acid residues to about 100 amino acid residues, or more amino acid residues in length, and any range therein, up to the full length of the sequence. In some embodiments, polypeptide sequences can be substantially identical to one another over at least about 8 consecutive amino acid residues (e.g., about 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 130, 140, 150, 175, 200, 225, 250, 300, 350, 400, 450, or 500 or more amino acids in length or more consecutive amino acid residues). In some embodiments, two or more myrosinase polypeptides, two or more AOP2 polypeptides or two or more CYP79F1 polypeptides may be identical (100%) or substantially identical (e.g., at least 70% to 99.9% identical; e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%. 99.9% identical or any range or value therein) to one another. In some embodiments, two or more myrosinase polypeptides, two or more AOP2 polypeptides or two or more CYP79F1 polypeptides proteins may be substantially identical across 10, 11, 12, 13, 14, 15, 16, 17, 18, 19, 20, 21, 22, 23, 24, 25, 26, 27, 28, 29, 30, 31, 32, 33, 34, 35, 36, 37, 38, 39 to about 40, 41, 42, 43, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 125, 130, 135, 140, 145, 150, 155, 160, 165, 170, 175, 180, 185, 190, 195, 200, 205, 210, 215, 220, 225, 230, 235, 240, 245, 250, 275, 300, 325, 350, 375, 400, 425, 450, 475, 500, 525, 540 or more consecutive amino acid residues. In some embodiments, two or more myrosinase polypeptides, two or more AOP2 polypeptides or two or more CYP79F1 polypeptides proteins may be substantially identical across 10, 15, 20, 25, 30 to 350, 400, 450, 500, or 540 or more of any one of the amino acid sequences of SEQ ID NOs: 93-105, 115, 128-132, 617-679 or 743-786.

"Complementary" or "complementarity" refers to the capacity for pairing, through base stacking and specific hydrogen bonding, between two sequences comprising naturally or non-naturally occurring bases or analogs thereof. For example, if a base at one position of a nucleic acid is capable of hydrogen bonding with a base at the corresponding position of a target, then the bases are considered to be complementary to each other at that position. Nucleic acids can comprise universal bases, or inert abasic spacers that provide no positive or negative contribution to hydrogen bonding. Base pairings may include both canonical Watson-Crick base pairing and non-Watson-Crick base pairing (e.g., Wobble base pairing and Hoogsteen base pairing). It is understood that for complementary base pairings, adenosine-type bases (A) are complementary to thymidine-type bases (T) or uracil-type bases (U), that cytosine-type bases (C) are complementary to guanosine-type bases (G), and that universal bases such as such as 3-nitropyrrole or 5-nitroindole can hybridize to and are considered complementary to any A, C, U, or T. Nichols et al., Nature, 1994; 369:492-493 and Loakes et al., Nucleic Acids Res., 1994; 22:4039-4043. Inosine (I) has also been considered in the art to be a universal base and is considered complementary to any A, C, U, or T. See Watkins and Santa Lucia, Nucl. Acids Research, 2005; 33 (19): 6258-6267.

As referred to herein, a "complementary nucleic acid sequence" is a nucleic acid sequence comprising a sequence of nucleotides that enables it to non-covalently bind to another nucleic acid in a sequence-specific, antiparallel, manner (i.e., a nucleic acid specifically binds to a complementary nucleic acid) under the appropriate in vitro and/or in vivo conditions of temperature and solution ionic strength. Complementarity between two single-stranded molecules may be "partial," in which only some of the nucleotides bind, or it may be complete when total complementarity exists between the single stranded molecules. The degree of complementarity between nucleic acid strands has significant effects on the efficiency and strength of hybridization between nucleic acid strands.

"Complement," as used herein, can mean 100% complementarity with the comparator nucleotide sequence or it can mean less than 100% complementarity (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like, complementarity) to the comparator nucleotide sequence.

Methods of sequence alignment for comparison and determination of percent sequence identity and percent complementarity are well known in the art. Optimal alignment of sequences for comparison can be conducted, e.g., by the homology alignment algorithm of Needleman and Wunsch, (1970) J. Mol. Biol. 48:443, by the search for similarity method of Pearson and Lipman, (1988) Proc. Nat'l. Acad. Sci. USA 85:2444, by computerized implementations of these algorithms (GAP, BESTFIT, FASTA, and TFASTA in the Wisconsin Genetics Software Package, Genetics Computer Group, 575 Science Dr., Madison, WI), by manual alignment and visual inspection (see, e.g., Brent et al., (2003) Current Protocols in Molecular Biology), by use of algorithms know in the art including the BLAST and BLAST 2.0 algorithms, which are described in Altschul et al., (1977) Nuc. Acids Res. 25:3389-3402; and Altschul et al., (1990) J. Mol. Biol. 215:403-410, respectively. Software for performing BLAST analyses is publicly available through the National Center for Biotechnology Information. Some alignment programs are MacVector (Oxford Molecular Ltd, Oxford, U.K.), ALIGN Plus (Scientific and Educational Software, Pennsylvania) and AlignX (Vector NTI, Invitrogen, Carlsbad, CA). Another alignment program is Sequencher (Gene Codes, Ann Arbor, Michigan), using default parameters, and MUSCLE (Multiple Sequence Comparision by Log-Expection; a computer software licensed as public domain).

As used herein, the term "hybridize" refers to pairing between complementary nucleotide bases (e.g., adenine (A) forms a base pair with thymine (T) in a DNA molecule and with uracil (U) in an RNA molecule, and guanine (G) forms a base pair with cytosine (C) in both DNA and RNA molecules) to form a double-stranded nucleic acid molecule. (See, e.g., Wahl and Berger (1987) *Methods Enzymol.* 152: 399; Kimmel, (1987) *Methods Enzymol.* 152:507). In addition, it is also known in the art that for hybridization between two RNA molecules (e.g., dsRNA), guanine (G) base pairs with uracil (U). For example, G/U base-pairing is partially responsible for the degeneracy (i.e., redundancy) of the genetic code in the context of tRNA anti-codon base-pairing with codons in mRNA. In the context of this disclosure, a guanine (G) of a protein-binding segment (dsRNA duplex) of a guide RNA molecule is considered complementary to a uracil (U), and vice versa. As such, when a G/U base-pair can be made at a given nucleotide position a protein-binding segment (dsRNA duplex) of a guide RNA molecule, the position is not considered to be noncomplementary, but is instead considered to be complementary. It is understood in the art that the sequence of polynucleotide need not be 100% complementary to that of its target nucleic acid to be specifically hybridizable. Moreover, a polynucleotide may hybridize over one or more segments such that intervening or adjacent segments are not involved in the hybridization event (e.g., a loop structure or hairpin structure). A polynucleotide can comprise at least 70%, at least 80%, at least 90%, at least 95%, at least 99%, or 100% sequence complementarity to a target region within the target nucleic acid sequence to which they are targeted.

The term "gene edited plant," "gene edited plant part" or "gene edited plant cell" as used herein refers to a plant, part thereof or cell that comprises one or more endogenous genes that are edited by a gene editing system. The gene editing system of the present invention comprises a targeting element and/or an editing element. The targeting element is capable of recognizing a target genomic sequence. The editing element is capable of modifying the target genomic sequence, e.g., by substitution or insertion of one or more nucleotides in the genomic sequence, deletion of one or more nucleotides in the genomic sequence, alteration of genomic sequences to include regulatory sequences, insertion of transgenes at a safe harbor genomic site or other specific location in the genome, and/or any combination thereof. A targeting element and an editing element can be on the same nucleic acid molecule or different nucleic acid molecules. In some embodiments, the editing element is capable of precise genome editing by substitution of a single nucleotide using a base editor, such cytosine base editor (CBE) and/or adenine base editor (ABE), which is directly or indirectly fused to a CRISPR-Cas effector protein.

General methods in molecular and cellular biochemistry can be found in such standard textbooks as Molecular Cloning: A Laboratory Manual, 3rd Ed. (Sambrook et al., HaRBor Laboratory Press 2001); Short Protocols in Molecular Biology, 4th Ed. (Ausubel et al. eds., John Wiley & Sons 1999); Protein Methods (Bollag et al., John Wiley & Sons 1996); Nonviral Vectors for Gene Therapy (Wagner et al. eds., Academic Press 1999); Viral Vectors (Kaplift & Loewy eds., Academic Press 1995); Immunology Methods Manual (I. Lefkovits ed., Academic Press 1997); and Cell and Tissue Culture: Laboratory Procedures in Biotechnology (Doyle & Griffiths, John Wiley & Sons 1998), the disclosures of which are incorporated herein by reference.

As used herein, the term "plant" refers to whole plants. The term "plant part" includes differentiated and undifferentiated tissues including, but not limited to: plant organs, plant tissues, roots, stems, shoots, rootstocks, scions, stipules, petals, leaves, flowers, ovules, pollens, bracts, petioles, internodes, bark, pubescence, tillers, rhizomes, fronds, blades, stamens, fruits, seeds, tumor tissue and plant cells (e.g., single cells, protoplasts, embryos, and callus tissue). Plant cells include, without limitation, cells from seeds, suspension cultures, embryos, meristematic regions, callus tissue, leaves, roots, shoots, gametophytes, sporophytes, pollen and microspores. The plant tissue may be in a plant or in a plant organ, tissue or cell culture. Thus, the term "plant part," as used herein, includes but is not limited to reproductive tissues (e.g., petals, sepals, stamens, pistils, receptacles, anthers, pollen, flowers, fruits, flower bud, ovules, seeds, and embryos); vegetative tissues (e.g., petioles, stems, roots, root hairs, root tips, pith, coleoptiles, stalks, shoots, branches, bark, apical meristem, axillary bud, cotyledon, hypocotyls, and leaves); vascular tissues (e.g., phloem and xylem); specialized cells such as epidermal cells, parenchyma cells, chollenchyma cells, schlerenchyma cells, stomates, guard cells, cuticle, mesophyll cells; callus tissue; and cuttings. The term "plant part" also includes plant cells, including plant cells that are intact in plants and/or parts of plants, plant protoplasts, plant tissues, plant organs, plant cell tissue cultures, plant calli, plant clumps, and the like. As used herein, "shoot" refers to the above ground parts including the leaves and stems. As used herein, the term "tissue culture" encompasses cultures of tissue, cells, protoplasts and callus. The term "stem" as used herein refers the above ground structural axis of the plant consisting of both nodes (e.g., leaves and flowers) and internodes (e.g., connecting material between nodes).

As used herein, "plant cell" refers to a structural and physiological unit of the plant, which typically comprise a cell wall but also includes protoplasts. A plant cell of the present invention can be in the form of an isolated single cell or can be a cultured cell or can be a part of a higher-organized unit such as, for example, a plant tissue (including callus) or a plant organ. A "protoplast" is an isolated plant cell without a cell wall or with only parts of the cell wall. Thus, in some embodiments of the invention, a transgenic cell comprising a nucleic acid molecule and/or nucleotide sequence of the invention is a cell of any plant or plant part including, but not limited to, a root cell, a leaf cell, a tissue culture cell, a seed cell, a flower cell, a fruit cell, a pollen cell, and the like. In some aspects of the invention, the plant part can be a plant germplasm. In some aspects, a plant cell can be non-propagating plant cell that does not regenerate into a plant.

"Plant cell culture" means cultures of plant units such as, for example, protoplasts, cell culture cells, cells in plant tissues, pollen, pollen tubes, ovules, embryo sacs, zygotes and embryos at various stages of development.

The term "plant organ" refers to plant tissue or a group of tissues that constitute a morphologically and functionally distinct part of a plant such as a root, stem, leaf, flower bud, or embryo.

"Plant tissue" as used herein means a group of plant cells organized into a structural and functional unit. Any tissue of a plant in planta or in culture is included. This term includes, but is not limited to, whole plants, plant organs, plant seeds, tissue culture and any groups of plant cells organized into structural and/or functional units. The use of this term in conjunction with, or in the absence of, any specific type of plant tissue as listed above or otherwise embraced by this definition is not intended to be exclusive of any other type of plant tissue.

As used herein, the term "tissue culture" indicates a composition comprising isolated cells of the same or a different type or a collection of such cells organized into parts of a plant. Exemplary types of tissue cultures are protoplasts, calli, plant clumps, and plant cells that can generate tissue culture that are intact in plants or parts of plants, such as embryos, pollen, flowers, seeds, leaves, stems, roots, root tips, anthers, pistils, meristematic cells, axillary buds, ovaries, seed coat, endosperm, hypocotyls, cotyledons and the like. In some embodiments of the invention, a transgenic tissue culture or transgenic plant cell culture is provided, wherein the transgenic tissue or cell culture comprises a nucleic acid molecule/nucleotide sequence of the invention. In some embodiments, transgenes may be eliminated from a plant developed from the transgenic tissue or cell by breeding of the transgenic plant with a non-transgenic plant and selecting among the progeny for the plants comprising the desired gene edit and not the transgenes used in producing the edit.

As used herein, "progeny" comprises any subsequent generation of a plant.

As used herein, the term "leafy green", "leafy green plant" or "leafy green vegetable" refers to a part of a plant high in vitamins, minerals and fiber but low in calories. The exemplary non-limiting leafy green plants include kale, collard greens, spinach, cabbage, beet greens, watercress, romaine lettuce, swiss chard, arugula, endive, bok choy, turnip greens, mustard greens cabbage, broccoli, cauliflower, Brussels sprouts, and kohlrabi.

Any plant or plant part comprising a glucosinolate pathway comprising one or more of a myrosinase, a CYP79F1 or an AOP2 may be useful with this invention. In some embodiments, a plant or plant part is a mustard plant (e.g., Brassicaceae). In some embodiments, the plant or plant part useful with this invention can include a plant from the Caricaceae family (e.g., *papaya*, e.g., *Carica papaya*). In some embodiments, the plant or plant part useful with this invention can include a plant from the Moringaceae family (e.g., Moringa spp.; e.g., *M. arborea, M. borziana, M. concanensis, M. drouhardii, M. hildebrantii, M. longituba, M. oleifera. M. ovalifolia, M. peregrine, M. pygmaea, M. rivae, M. ruspoliana,* or *M. stenopetala*).

Example mustard plants (or parts there of) (e.g., Brassicaceae plant or part thereof). include, but are not limited to, a kale plant or part thereof, a collard plant or part thereof, a spinach plant or part thereof, a cabbage plant or part thereof, a beet plant or part thereof, a watercress plant or part thereof, a lettuce plant or part thereof (e.g. romaine), a swiss chard plant or part thereof, an arugula plant or part thereof, an endive plant or part thereof, a bok choy plant or part thereof, a rutabaga plant or part thereof, a turnip plant or part thereof, a mustard plant or part thereof, a cabbage plant or part thereof, a broccoli plant or part thereof, a cauliflower plant or part thereof, a Brussels sprout plant or part thereof, a radish plant or part thereof, or a kohlrabi plant or part thereof. In some embodiments, a mustard plant or part thereof may include, but is not limited to, *Brassica oleracea* (e.g., *B. oleracea* var. *oleracea, B. oleracea* var. *capitata, B. oleracea* var. *botrytis, B. oleracea* var. *gemmifera, B. oleracea* var. *sabauda, B. oleracea* var. *gongyiodes, B. oleracea* var. *italic, B. oleracea* var. *sabellica, B. oleracea* var. *acephala*), *Brassica juncea, Brassica rapa* (*B. rapa* subsp. *pekinensis, B. rapa* subsp. *Chinensis, B. rapa* subsp. *rapa*), *Brassica* napas, *Brassica carinata, Brassica campestris Brassica nigra* or *Raphanus* raphanistrum (e.g., *Raphanus* raphanistrum subsp. *Sativus*).

Vegetables are known as "protective foods" in human diet with varied health benefits attributable to richness in vitamins, essential fatty acids, minerals, amino acids and dietary fiber and various essential bioactive compounds, including health-promoting plant secondary metabolites composed of antioxidants and phenolic compounds. Globally, crop diversity and nutritional value of vegetable crops are of special significance for improving food and nutrition security.

Plants are major sources of numerous bioactive compounds collectively termed as phytochemicals, which are reported to be key to good health. The composition of phytochemicals is very distinctive and varies widely amongst plants. For instance, vegetables that belong to the Alliaceae family (e.g., onions, garlic, shallots, leek, Welsh onion, chives and etc.) are characterized by thiosulfides and flavonoids. Cruciferous vegetables that belong to the Brassicaceae family (e.g., brussels sprout, cabbage, cauliflower, mustard, kale, broccoli and etc.) contain high sources of glucosinolates, and those that belong to Cucurbitaceae family (e.g., squash, pumpkin, cucumber, melon, bitter gourd and etc.) are rich in carotenoids and tocopherols. Other plants that comprise higher levels of glucosinolates include the Caricaceae family and the Moringaceae family.

The Brassicaceae (also called Cruciferae) family, commonly known as the mustard family. The genus *Brassica* is a member of the tribe Brassiceae in the mustard family (Warwick, S. I., A. Francis and R. K. Gugel (2009), "Guide to wild germplasm: *Brassica* and allied crops (Tribe Brassiceae, Brassicaceae)", Third Edition, brassica.info/info/publications/guidewild-germplasm.php). The *Brassica* genus includes many economically important plants such as leaf and root vegetables, oilseed and condiment crops, and the model plant *Arabidopsis thaliana*. Brassicaceae vegetables are widely cultivated, with many genera, species, and cultivars including *B. carinata* (Ethiopian mustard), *B. juncea* (brown mustard, mustard green), *B. napus* (rape, Argentine canola, rapeseed and rutabaga), *B. nigra* (black mustard), *B. rapa* (field mustard, Polish canola, Chinese cabbage, Chinese mustard, bok choy and turnip), *B. oleracea* food crops (cabbage, broccoli, cauliflower, Brussels sprouts, kohlrabi and kale) and *Raphanus sativus* (radish).

The limitation of the *Brassica* plants as a feed additive and/or a fresh green leafy vegetable is its relatively high content of glucosinolates. The present invention is directed to reducing the 'mustard bomb' reaction and to produce leafy greens with reduced pungency and/or reduced bitterness in flavor and/or odor, which would thereby encourage broader consumption of fresh healthy leafy greens. In addition, the present invention is directed to modifying similar chemical herbivory defense systems, found in other vegetables, to promote the consumption of additional fresh vegetables that are less pungent and/or less bitter.

Glucosinolates

Glucosinolates constitute a large family of over 100 related molecules with a common sulfur containing core structure and with side chains of varying size and chemistry (Fahey et al., (2001) *Phytochemistry* 56:5-51; Halkier and Gershenzon, (2006) *Ann. Rev. Plant Biology* 57 (1): 303-333). While glucosinolates are found in many plant structures (leaf, vascular tissue, stem, root, and flowers, to cite some examples), they are accumulated in high concentrations in the seed (Bellostas et al., (2004) *Agroindustria* 3 (3): 5-10). This is particularly true for the brassicas. These compounds and their metabolites can impact the taste of the meal, reducing its palatability and in some cases (dependant on the type of glucosinolate and glucosinolate metabolites present) can also impact the health of consumers directly and/or indirectly.

Glucosinolates, of which nearly 200 types having different substituents have been identified, are grouped into three classes based on the structure of different amino acid precursors: aliphatic glucosinolates, indole glucosinolates, and aromatic glucosinolates.

Example aliphatic glucosinolates include, but are not limited to, sinigrin, glucoiberin, glucoiberverin, glucoerucin, dehydroerucin, glucoraphanin, glucoraphenin, gluconapin, progoitrin, glucoberteroin, glucoalyssin, glucobrassicanapin, and gluconapoleiferin.

In some embodiments, indole glucosinolates include, but are not limited to, glucobrassicin, 4-Hyroxyglucobrassicin, 4-Methoxyglucobrassicin, and neoglucobrassicin.

In some embodiments, aromatic glucosinolates include, but are not limited to, gluconasturtiin.

Glucosinolates occur as secondary metabolites of almost all plants of the order Brassicales. Ordered in the Brassicales are for example the economically important family Brassicaceae as well as Capparaceae, Moringaceae and Caricaceae. Outside of the Brassicales, the genera Drypetes and Putranjiva in the family Putranjivaceae also produce glucosinolates. Glucosinolates occur in various edible plants such as cabbage (white cabbage, Chinese cabbage, broccoli) watercress, horseradish, capers and radishes where the breakdown products often contribute a significant part of the distinctive taste. The glucosinolates are also found in seeds of these plants.

Glucosinolates are natural components of many pungent plants such as mustard, cabbage, and horseradish. The pungency (and/or bitterness) of those plants is due to mustard oils produced from glucosinolates when the plant material is chewed, cut, or otherwise damaged. These natural chemicals most likely contribute to plant defense against pests and diseases, and impart a characteristic bitter flavor property of cruciferous vegetables.

Unique secondary metabolites, glucosinolates (S-glucopyranosyl thiohydroximates), are naturally occurring S-linked glucosides found mainly in Brassicaceae plants but also in plants in the Caracaceae and Moringaceae families. They are enzymatically hydrolyzed to produce sulfate ions, D-glucose, and characteristic degradation products such as isothiocyanates. The functions of glucosinolates in the plants remain unclear, but isothiocyanates possessing a pungent or irritating taste and odor might be associated with plant defense from microbes.

The present disclosure provides plants and methods for producing plants with reduced pungency and/or bitterness in flavor and odor by altering and/or modulating the mustard bomb reaction.

Mustard Bomb Reaction

In response to biotic challenges, plants have evolved a broad variety of defense mechanisms. Plants have developed physical and chemical barriers using inducible defenses, one of which is the glucosinolate-myrosinase system (FIG. 6), also referred to as the "mustard oil bomb" or "mustard bomb" reaction. Cruciferous plants (such as plants in the Brassicaceae family (e.g., *Brassica* spp.)) and other glucosinolate producing plant species synthesize glucosinolates, a class of plant secondary compounds that share a core consisting of a β-thioglucose moiety and a sulfonated oxime, but differ by a variable side chain derived from one of several amino acids. However, intact glucosinolates have limited biological activity. Their potency arises when plant tissue is damaged, and glucosinolates come into contact with plant myrosinase, a β-thioglucosidase. In intact tissue, this enzyme is stored separate from glucosinolates (Matile P. H. Matile P. H. (1980) *Biochem. Physiol. Pflanz.*175,722-731; Bones A. M. Bones A. M. & Rossiter, J. T. (1996) *Physiol. Plant.* 97,194-208). Myrosinase removes the β-glucose moiety from glucosinolates, leading to the formation of an unstable intermediate, and, finally, to a variety of toxic breakdown products. These compounds have diverse biological activity ranging from feeding deterrent to pungent taste/flavor.

Figure 6:
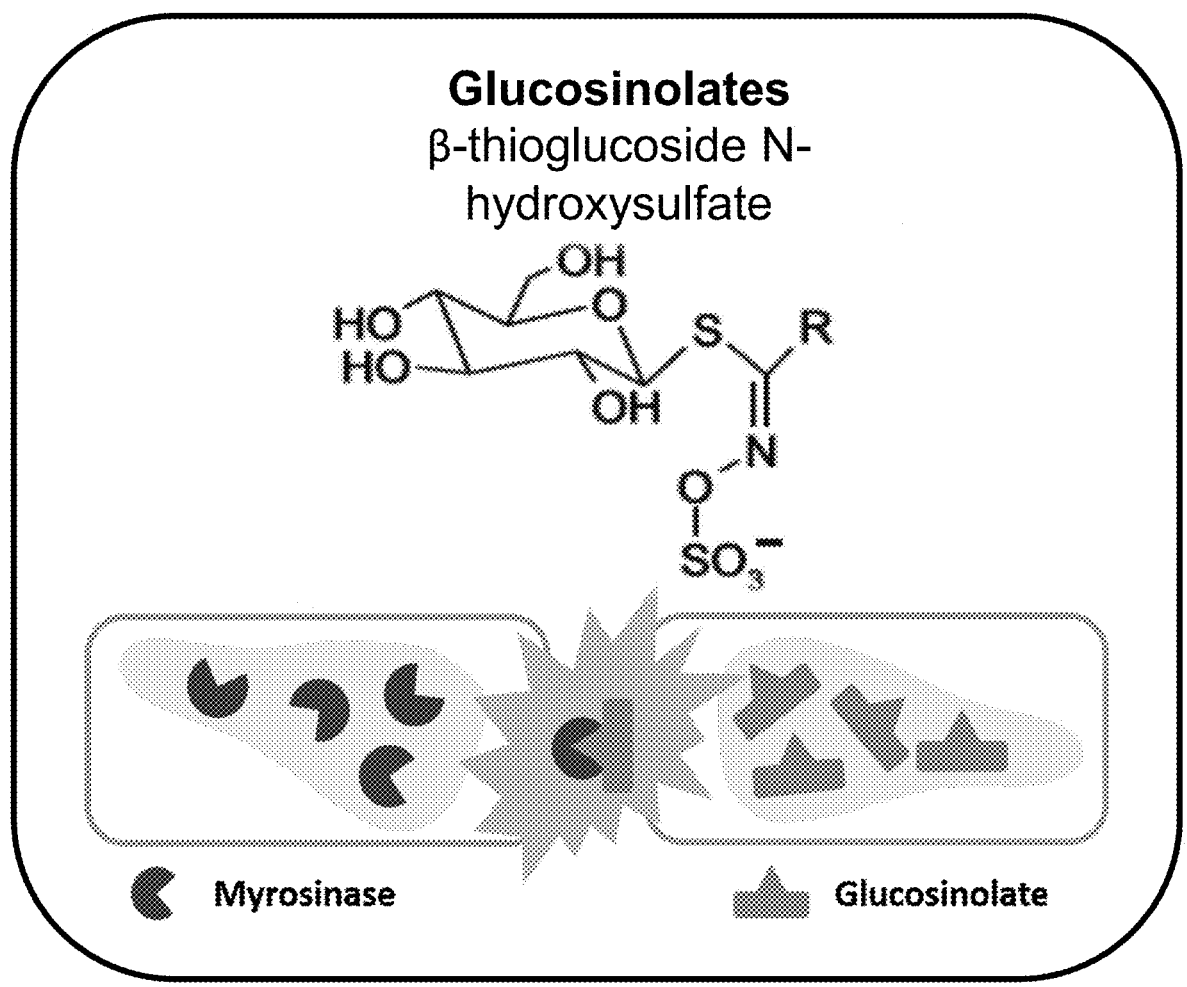
FIG. 6 illustrates glucosinolate metabolism by myrosinase and production of thioglucoside N-hydrosulfate.

Within Brassicaceae, a specialized chemical reaction has evolved which is mediated by a spatially separated enzyme (myrosinase) and substrate pool (glucosinolates). Upon tissue damage (i.e. herbivory), myrosinases come into contact with the glucosinolates and various degradation products can be produced; some of which are strongly pungent (i.e. allyl isothiocyanate; AITC) (FIG. 6). Thus, this reaction has evolved as an anti-herbivory mechanism.

Genetic engineering approaches using T-DNA insertion was used to disarm and functionally characterize the mustard bomb reaction. Specifically, characterization of *Arabidopsis* T-DNA insertion mutants identified a critical role for 2 out of the 3 known Type I myrosinases for regulating the chemical reaction (Barth and Jander, Plant J. 46 (4) 549-562 (2006)). In *B. juncea*, RNAi-mediated silencing of regulators (MYB28, AOP2) involved in the secondary metabolism of glucosinolates (Augustine and Bisht, *Phytochem.* 117:43-50 (2015)); Augustine et al., *Plant Biotechnol J.* 11 (7): 855-866 (2013)). Characterization of 84 natural accessions of *B. napus* genetically associated MYB28 to a QTL for glucosinolate content in seeds (Harper et al. *Nature Biotechnol.* 30, 798-802 (2012)).

Reduction of glucosinolates degradation products (e.g., isothiocyanates) in plants is an objective of the present invention and plants comprising reduced ability to produce glucosinolate degradation products can have significant nutritional benefits. Thus, the present disclosure is directed to a targeted gene editing approach to disarm the mustard bomb reaction by disruption of glucosinolate metabolism through knockouts of genes encoding myrosinase enzymes (see, e.g., FIG. 6 and FIG. 7), AOP2 enzymes, and/or CYP79F1 enzymes. In some embodiments, aliphatic glucosinolate metabolism is disrupted by gene-editing systems. In some embodiments, indole glucosinolate metabolism is disrupted by gene-editing systems. In some embodiments, aromatic glucosinolate metabolism is disrupted by gene-editing systems.

In some embodiments, genes encoding myrosinase enzymes (i.e., glucosinolase, thioglucosidase (e.g., β-thioglucosidase), thioglucoside glucohydrolase; EC 3.2.1.147 (EC 3.2.3.1 transferred to 3.2.1.147)), are targeted to be knocked out so that the target genes are functionally inoperative in a host plant cell, tissue and/or whole plant. In some embodiments, genes encoding AOP2 enzymes (i.e., a 2-oxo acid-dependent dioxygenase; EC 1.14.11.M8) are targeted to be knocked out so that the target genes are functionally inoperative in a host plant cell, tissue and/or whole plant. In some embodiments, genes encoding CYP79F1 enzymes (i.e., a cytochrome P450 mono-oxygenase, homomethionine N-monooxygenase; EC 1.14.14.42) are targeted to be knocked out so that the target genes are functionally inoperative in a host plant cell, tissue and/or whole plant.

Significant diversity exists within *Brassica* spp. and the cultivars within these species. For example, in *Brassica juncea*, there is a wide variation of leaf shapes, colors, textures and phenological traits across cultivars. The present disclosure teaches that the available leafy *B. juncea* cultivars are accompanied with pungency and/or bitterness when fresh leaves are consumed, which is perceived as a potential barrier for the broad adoption of fresh leafy vegetables, for example mustard greens, within the consumer space. However, the consumption of the fresh green leafy *brassica* vegetables would provide the consumer with a greater nutritious benefit than other readily available lettuce options such as romaine and iceberg.

According to the present invention, a modified plant cell(s) as described herein demonstrates an altered expression or function of one or more endogenous target genes. In some embodiments, the expression of an endogenous target gene in a particular pathway (e.g., the glucosinolate biosynthesis or glucosinolate breakdown, e.g., endogenous myrosinase genes, endogenous CYP79F1 genes, and/or endogenous AOP2 genes) is reduced in the modified plant cells. In some embodiments, the expression of a plurality (e.g., two or more) of endogenous target genes in a particular pathway is reduced in the modified plant cell(s). For example, the expression of 2, 3, 4, 5, 6, 7, 8, 9, 10, 11, 12, 13, or 14, or more endogenous target genes in a particular pathway may be reduced. In some embodiments, the expression of an endogenous target gene in one pathway and the expression of an endogenous target gene(s) in another pathway may be reduced in the modified plant cells. In some embodiments, the expression of a plurality of endogenous target genes in one pathway and the expression of a plurality of endogenous target genes in another pathway may be reduced in the modified plant cell(s). For example, the expression of 2, 3, 4, 5, 6, 7, 8, 9, 10, 11, 12, 13, or 14, or more endogenous target genes in one pathway may be reduced and the expression of 2, 3, 4, 5, 6, 7, 8, 9, 10, 11, 12, 13, or 14, or more endogenous target genes in another pathway may be reduced. In some embodiments, the expression of a plurality of endogenous target genes in a plurality of pathways may be reduced. For example, the expression of one endogenous gene from each of a plurality of pathways (e.g., 2, 3, 4, 5, 6, 7, 8, 9, 10, 11, 12, 13, or 14, or more pathways) may be reduced. In some aspects, the expression of a plurality of endogenous genes (e.g., 2, 3, 4, 5, 6, 7, 8, 9, 10, 11, 12, 13, or 14, or more e genes) from each of a plurality of pathways (e.g., 2, 3, 4, 5, 6, 7, 8, 9, 10, 11, 12, 13, or 14, or more pathways) may be reduced.

In some embodiments, the function of a protein encoded by an endogenous target gene in a particular pathway (e.g., glucosinolate biosynthesis or breakdown) is altered in the modified plant cell(s). In some embodiments, the functions of proteins encoded by a plurality (e.g., two or more) of endogenous target genes in a particular pathway are altered in the modified plant cell(s) (e.g., glucosinolate biosynthesis or breakdown). For example, the function of proteins encoded by 2, 3, 4, 5, 6, 7, 8, 9, 10, 11, 12, 13, or 14, or more endogenous target genes in a particular pathway may be altered. In some embodiments, the function of a protein encoded by an endogenous target gene in one pathway and the function of an endogenous target gene in another pathway is altered in the modified plant cells. In some embodiments, the functions of proteins encoded by a plurality of endogenous target genes in one pathway and the function of proteins encoded by a plurality of endogenous target genes in another pathway are altered in the modified plant cells. For example, the function of proteins encoded by 2, 3, 4, 5, 6, 7, 8, 9, 10, 11, 12, 13, or 14, or more endogenous target genes in one pathway may be altered and the function of proteins encoded by 2, 3, 4, 5, 6, 7, 8, 9, 10, 11, 12, 13, or 14, or more endogenous target genes in another particular pathway may be altered. In some embodiments, the functions of proteins encoded by a plurality of endogenous target genes in a plurality of pathways are altered. For example, the function of a protein encoded by one endogenous gene from each of a plurality of pathways (e.g., 2, 3, 4, 5, 6, 7, 8, 9, 10, 11, 12, 13, or 14, or more pathways) may be altered. In additional aspects, the function of proteins encoded by a plurality of endogenous genes (e.g., 2, 3, 4, 5, 6, 7, 8, 9, 10, 11, 12, 13, or 14, or more genes) from each of a plurality of pathways (e.g., 2, 3, 4, 5, 6, 7, 8, 9, 10, 11, 12, 13, or 14, or more pathways) may be altered.

In some embodiments, the modified plant cells described herein demonstrate an altered expression or function of one or more endogenous target genes encoding myrosinase (i.e., glucosinolase, thioglucosidase (i.e., β-thioglucosidase), thioglucoside glucohydrolase; EC 3.2.1.147 (EC 3.2.3.1 transferred to 3.2.1.147)), encoding 2-oxoglutarate-dependent dioxygenase (i.e., AOP2; EC 1.14.11.M8) or encoding a cytochrome P450 mono-oxygenase (i.e., CYP79F1, homomethionine N-monooxygenase; EC 1.14.14.42) and/or associated with glucosinolate metabolism.

Various plants in the Brassicaceae family contain multiple forms (orthologs) of myrosinase genes divided into several subfamilies (Rask et al., (2000) Plant Mol. Biol. 42, 93-113; Thangstad et al., (1993) Plant Mol. Biol. 23, 511-524; Xue et al., (1992) Plant Mol. Biol. 18, 387-398). However, only one myrosinase gene family (TGG1-TGG6) is present in Arabidopsis (Xu et al., (2004) Plant Mol. Biol. 55, 343-367). Here, there are two sets of paired myrosinases, each with one intervening gene of unknown function: TGG1 (At5g26000) and TGG2 (At5g25980), and TGG5 (At1g51470) and TGG6 (At1g51490). TGG3 (At5g48375) and TGG4 (At1g47600) are single genes.

In some embodiments, the candidate genes for gene editing in mustard plants can be selected from orthologs of Arabidopsis myrosinase genes (Type I and II) with a total of three of each type. Two Type I myrosinases (TGG1 and TGG2) are required for the production of allyl isothiocyanate (AITC) (Barth and Jander, Plant J. 46 (4) 549-562 (2006)).

In some embodiments, a bioinformatics approach is used to identify myrosinase orthologs, e.g., a total of seven B. juncea myrosinase orthologs are identified that are closely related to the Type I myrosinases (TGG1 and TGG2) in Arabidopsis. In some embodiments, expression analyses may be utilized to identify candidate genes encoding myrosinases that show leaf-specific expression.

In some embodiments, the candidate genes for gene editing in mustard plants are selected from homologs and/or orthologs of Arabidopsis myrosinase genes, selected from TGG1, TGG2, TGG3, TGG4, TGG5, and TGG6, and fragments of said homologs and/or orthologs thereof.

In order to ensure precise target mutations with the greatest likelihood for disruption of enzymatic properties, sequence analysis was performed relative to the known active site (see, e.g., Burmeister et al., Structure 5, 663-675 (1997)). The inventors have also identified 4 homologs/ orthologs that correspond to TGG4/TGG5/TGG6 (Type II myrosinases). Thus, in some embodiments, a myrosinase gene useful for targeting as described herein may be a nucleic acid having at least 80% sequence identity (e.g., 80, 81, 82, 83, 84, 85, 86, 87, 88, 89, 90, 91, 92, 93, 94, 95, 96, 97, 98, 99, or 100%) to any one of the nucleotide sequences of SEQ ID NOs: 66-92 or 680-721 or encoding a sequence having at least 80% sequence identity to any one of the amino acid sequences of SEQ ID NOs: 93-105, 617-658 or 743-775. In some embodiments, a myrosinase gene useful for targeting as described herein may be comprise any one of the nucleotide sequences of SEQ ID NOs: 66-92 or 680-721 or encode any one of the amino acid sequences of SEQ ID NOs: 93-105, 617-658 or 743-775. In some embodiments, a plant may comprise more than one myrosinase gene (e.g., 1, 2, 3, 4, 5, 6, 7, 8, 9, 10, 11, 12, or 13 or more) and more than one myrosinase gene may be targeted for editing. In some embodiments, one myrosinase gene is edited to produce a reduced amount of or no myrosinase polypeptide from that edited gene. In some embodiments, at least two myrosinase genes are edited to produce a reduced amount of or no myrosinase polypeptide from each edited gene. In some embodiments, two myrosinase genes are edited to produce a reduced amount of or no myrosinase polypeptide from each of the two edited myrosinase genes. In some embodiments, three myrosinase genes are edited to produce a reduced amount of or no myrosinase polypeptide from each of the three edited myrosinase genes. In some embodiments, four myrosinase genes are edited to produce a reduced amount of or no myrosinase polypeptide from each of the four edited myrosinase genes. In some embodiments, five myrosinase genes are edited to produce a reduced amount of or no myrosinase polypeptide from each of the five edited myrosinase genes. In some embodiments, six myrosinase genes are edited to produce a reduced amount of or no myrosinase polypeptide from each of the six edited myrosinase genes. In some embodiments, seven myrosinase genes are edited to produce a reduced amount of or no myrosinase polypeptide from each of the seven edited myrosinase genes. In some embodiments, eight myrosinase genes are edited to produce a reduced amount of or no myrosinase polypeptide from each of the eight edited myrosinase genes. In some embodiments, nine myrosinase genes are edited to produce a reduced amount of or no myrosinase polypeptide from each of the nine edited myrosinase genes. In some embodiments, ten myrosinase genes are edited to produce a reduced amount of or no myrosinase polypeptide from each of the ten edited myrosinase genes. In some embodiments, eleven myrosinase genes are edited to produce a reduced amount of or no myrosinase polypeptide from each of the eleven edited myrosinase genes. In some embodiments, twelve myrosinase genes are edited to produce a reduced amount of or no myrosinase polypeptide from each of the twelve edited myrosinase genes. In some embodiments, thirteen myrosinase genes are edited to produce a reduced amount of or no myrosinase polypeptide from each of the thirteen edited myrosinase genes.

In some embodiments, gene editing of target site(s) in a myrosinase gene may be carried out by a targeted insertion/deletion approach using, for example, a CRISPR-Cas effector protein (e.g., Cpf1 or Cas9). This approach can provide spatial context and can ensure that breakage, disruption, and/or damage of protein functionality, optionally within a highly conserved and known functional region of the enzymes.

In some embodiments, a targeted deletion in a myrosinase gene results in an in-frame or an out-of-frame deletion. In some embodiments, a targeted deletion in a myrosinase gene results in an in-frame or an out-of-frame deletion that produces a premature stop codon and optionally a truncated polypeptide. In some embodiments, a targeted deletion is a null allele. In some embodiments the null allele may be a full knockout mutant myrosinase allele, wherein the full knockout mutant myrosinase allele results in the production of a nonfunctional myrosinase protein or no production of a myrosinase protein.

In some embodiments, gene editing of target site(s) in a myrosinase gene may be carried out via a stable and targeted base-editing approach using, for example, a base editing fusion protein comprising a CRISPR-Cas effector protein and a cytidine deaminase or adenosine deaminase. This approach could serve to selectively and precisely guide base editing approaches which target nucleotides encoding specific residues within, for example, an active site in a myrosinase polypeptide.

Glucosinolates are nitrogen and sulfur rich secondary metabolites which are derived from amino acids and sugars. They represent one of the largest known groups of secondary metabolites within the Brassicaceae family and have garnered significant attention for both human and animal health. For humans, glucosinolates and their break-down products are commonly associated to health benefits. Conversely, for animal feed, they are often recognized as antinutritive compounds and goitrogenic.

In some embodiments, the candidate genes for gene editing in mustard plants are selected from genes associated with aliphatic glucosinolate metabolism. In other embodiments, the candidate genes for gene editing in mustard plants are selected from genes associated with indole glucosinolate metabolism. In further embodiments, the candidate genes for gene editing in mustard plants are selected from genes associated with aromatic glucosinolate metabolism. In some embodiments, gene editing of target site(s) in genes associated with aliphatic, indole, or aromatic glucosinolate metabolism occurs by a targeted insertion/deletion approach using a CRISPR-Cas effector protein (e.g., Cpf1 or Cas9), optionally a deletion that produces a truncated protein, optionally a full knockout mutation (e.g., no protein production or production of non-functional protein). This approach provides spatial context and can ensure that breakage, disruption, and/or damage of protein functionality, optionally across highly conserved and known functional regions of the enzymes.

In some embodiments, gene editing of target site(s) in associated with aliphatic, indole, or aromatic glucosinolate metabolism may occur via a stable and targeted base-editing approach using a base editing fusion protein comprising a CRISPR-Cas effector protein and a base editor (e.g., a cytidine deaminase or adenosine deaminase). This approach could serve to selectively and precisely guide base editing approaches which target specific residues within the active site or may be used to alter codons and produce for example, premature stop codons and truncated proteins.

MYB Transcription Factors

Using *Arabidopsis* as a model, MYB transcription factors were revealed as the major positive transcriptional regulators of glucosinolate biosynthesis, with MYB28 regulating genes involved with aliphatic glucosinolate biosynthesis (Gigolashvili et al., *Plant J.* 51 (2): 247-261 (2007)). Sinigrin, which is a predominant glucosinolate in *B. juncea* and substrate for the production of the pungent AITC compound, originates from methionine in the aliphatic branch of glucosinolate biosynthesis. Previous efforts using RNAi based approaches in *B. juncea* have functionally demonstrated the role of MYB28 to regulate the pool of aliphatic glucosinolates (Augustine et al., *Plant Biotechnol J.* 11 (7): 855-866 (2013)). Additional studies were performed in *Brassica napus*, *Brassica oleracea* and *Brassica rapa*.

In some embodiments, six MYB28 genes in *B. juncea* were identified by a bioinformatics analysis. Conserved regions were identified for targeting by, for example, a CRISPR-Cas complex for the generation of insertion/deletion (indel) that, for example, disrupts protein functionality or for targeting by a base-editing system for a stable and targeted single nucleotide substitution/deletion/addition at at least one site.

In some embodiments, MYB29 transcription factors may have partial redundant function. For example, the biosynthesis of aliphatic glucosinolates compounds can be regulated by transcription factors MYB28 and MYB29, which are partially redundant. (The Impact of the Absence of Aliphatic Glucosinolates on Insect Herbivory in *Arabidopsis*. Beekwilder, Jules; Wessel van Leeuwen; van Dam, Nicole M; Bertossi, Monica; Grandi, Valentina; et al. *PLOS One*; San Francisco Vol. 3, Iss. 4, (April 2008): e2068).

Thus, in some embodiments, a candidate gene for gene editing in mustard plants are selected from genes associated with aliphatic glucosinolate metabolism, which include six MYB28 genes identified in *B. juncea*. In further embodiments, gene editing of target site(s) in *B. juncea* MYB28 and/or MYB29 genes occurs by a targeted insertion/deletion approach using, for example, Cpf1 or Cas9. This approach provide spatial context and can ensure that breakage, disruption, and/or damage of protein functionality, optionally within, for example, a highly conserved and known functional region of the enzymes. In some embodiments, gene editing of target site(s) in *B. juncea* MYB28 and/or MYB29genes occurs by a stable and targeted base-editing approach using a base editing fusion protein comprising a CRISPR-Cas effector protein and a cytidine deaminase or adenosine deaminase. This approach may provide selectively and precisely guide base editing in which specific residues may be targeted within, for example, an active site. The present disclosure teaches that gene editing can give rise to precise control for complete disruption of (1) genes encoding myrosinase enzymes, (2) transcription factors regulating the secondary metabolic pool of glucosinolates (such as MYB28 and/or MYB29), or (3) disruption of genes encoding enzymes which are responsible for the conversion of glucosinolates into their final degradation products.

GSL-ALK (AOP) Enzyme

Glucosinolates (GSL) are amino acid derived secondary metabolites, invariably present in *Brassica* plants, which have health and agricultural benefits. Glucoraphanin (GRA) is the most studied glucosinolate with respect to health benefits derived from its breakdown product (sulphoraphane known to posses anti-cancer properties). GRA is present in high quantities in many cruciferous species such as broccoli having the highest amount of GRA. Other members of *Brassica oleracea* like Chinese kale, cabbage and Brussels sprout also possess significant amounts of GRA. However, numerous *Brassica* cultivars cultivated for oil seed or leaf consumption contain negligible or low amount of GRA, including *B. juncea*. Gluconapin (GNA), sinigrin (SIN) and glucobrassicin (GBN) are the major aliphatic glucosinolates present in *B. juncea*.

The GSL-ALK or AOP2 (i.e., 2-oxoglutarate-dependent dioxygenase, 2-oxo acid-dependent dioxygenases; EC 1.14.11.M8) plays a role in the secondary modification of aliphatic (methionine-derived) glucosinolates, namely the conversion of methylsulfinylalkyl glucosinolates to form alkenyl glucosinolates, and also influences aliphatic glucosinolate accumulation. (see, e.g., Zhang et al. *J. Exp. Bot.* 66 (2): 6205-6218 (2015); Agnieska et al. *Nat. Commun.* 7:13390 (2016); Neal et al. *BMC Plant Biol* 10:170 (2010); Burow et al. *Mol. Plant* 8:1201-1212 (2015)). AOP2 catalyzes the conversion of the beneficial glucoraphanin to the deleterious breakdown products of progoitrin and gluconapin; which are found at high levels in *B. juncea* and most cultivated Brassicas. Importantly, AOP2 also converts glucoiberin into the breakdown product of sinigrin, which serves as the substrate for myrosinase to produce the pungent compound allyl isothiocyanate (AITC).

A targeted reduction of AOP2 homologues in *B. juncea* can have a two-fold benefit; firstly, promotion for the accumulation of glucoraphanin; and secondly, prevention of the accumulation of sinigrin. Importantly, RNAi based suppression of the four AOP2 enzymes in *B. juncea* resulted in a drastic reduction of sinigrin and significant enrichment of glucoraphanin; without undesirable effects on growth (Augustine and Bisht, *Phytochem.* 117:43-50 (2015)).

In some embodiments, gene editing of target site(s) in an AOP2 gene may be carried out by a targeted insertion/deletion approach using, for example, a CRISPR-Cas effector protein (e.g., Cpf1 or Cas9). This approach can provide spatial context and can ensure that breakage, disruption, and/or damage of protein functionality, optionally within a highly conserved and known functional region of the enzymes.

In some embodiments, gene editing of target site(s) in AOP2 genes (e.g., *B. juncea* AOP2 genes) may be carried out via stable and targeted base-editing approach using a base editing fusion protein comprising a CRISPR-Cas effector protein and for example, a cytidine deaminase or adenosine deaminase. Using such an approach, specific residues may be selectively and precisely base edited.

Accordingly, as disclosed herein, targeted alteration of glucosinolate metabolism such as AOP2 genes can be used to reduce pungency and/or bitterness in mustard plants. In some embodiments, genes for gene editing in mustard plants (e.g., leafy greens) may be, for example, genes encoding *B. juncea* AOP2 enzymes (e.g., BjuA.GSLALK-1, BjuA.GSLALK-2, BjuB.GSLALK-1, BjuB.GSLALK-2). In some embodiments, an AOP2 gene that may modified to reduce pungency and/or bitterness in a mustard plant can include an AOP2 gene that encodes a polypeptide having at least 80% (e.g., about 80, 81, 82, 83, 84, 85, 86, 87, 88, 89, 90, 91, 92, 93, 94, 95, 96, 97, 98, 99, or 100%) sequence identity to any one of the amino acid sequences of SEQ ID NOs: 128, 129, 130, 131, 132, 659-673 or 776-781, or comprises a sequence having at least 80% sequence identity to any one of the nucleotide sequences of SEQ ID NOs: 118, 119, 120, 121, 122, 123, 124, 125, 126, 127 or 722-736. In some embodiments, an AOP2 gene that may be modified (e.g., edited) to reduce pungency and/or bitterness in a mustard plant can include an AOP2 gene that encodes any one of the amino acid sequences of SEQ ID NOs: 128-132, 659-673 or 776-781 or comprises any one of the nucleotide sequences of SEQ ID NOs: 118-127 or 722-736.

In some embodiments, one AOP2 gene is edited to produce a reduced amount of or no AOP2 polypeptide from that edited gene. In some embodiments, at least two AOP2 genes are edited to produce a reduced amount of or no AOP2 polypeptide from each edited gene. In some embodiments, two AOP2 genes are edited to produce a reduced amount of or no AOP2 polypeptide from each of the two edited AOP2 genes. In some embodiments, three AOP2 genes are edited to produce a reduced amount of or no AOP2 polypeptide from each of the three edited AOP2 genes. In some embodiments, four AOP2 genes are edited to produce a reduced amount of or no AOP2 polypeptide from each of the four edited AOP2 genes. In some embodiments, five AOP2 genes are edited to produce a reduced amount of or no AOP2 polypeptide from each of the five edited AOP2 genes In some embodiments, a targeted deletion in an AOP2 gene results in an in-frame or an out-of-frame deletion. In some embodiments, a targeted deletion in an AOP2 gene results in an in-frame or an out-of-frame deletion that produces a premature stop codon and optionally a truncated polypeptide. In some embodiments, such a targeted deletion is a null allele. In some embodiments the null allele may be a full knockout mutant AOP2 allele, wherein the full knockout mutant AOP2 allele results in the production of a nonfunctional AOP2 protein or no production of AOP2 protein.

Cytochrome P450 Mono-Oxygenase (CYP79) Family

In some embodiments, core glucosinolate biosynthesis may be inhibited to reduce pungency and/or bitterness. In some embodiments, the glucosinolate biosynthetic enzyme cytochrome P450 mono-oxygenase (CYP79F1) (i.e., homomethionine N-monooxygenase) (Reintanz et al. *Plant Cell* 13 (2): 351-167 (2001); Hansen et al. *J. Biol. Chem* 276 (14): 1178-11085 (2001); Chen et al. *Plant J.* 33:923-937 (2003); Sharma et al. *PLOS One* 11 (2): e) 150060 pages 1-17 (2016); Yin et al. *Molecules* 20 (11): 20254-20267 (2015)), which regulates the flux of synthesis after chain elongation of both methionine-derived (Sønderby et al. *Trends Plant Sci.*, 15:283-290 (2010)) and branched-chain amino acid derived glucosinolates may be targeted for modification. As an example, a knockout of CYP79F1 in *Arabidopsis thaliana* prevented the synthesis of short-chain aliphatic glucosinolates (Reintanz et al. *Plant Cel* 13 (2): 351-367 (2001)). In *Brassica juncea*, loss of function mutation due to a transposable element insertion within the gene results in a nearly signigrin-free plant (Sharma et al. *PLOS One* 11 (2): e) 150060 pages 1-17 (2016)).

Thus, the present disclosure is directed to targeted inhibition of glucosinolate biosynthesis. In some embodiments, the candidate genes for gene editing in mustard plants (e.g., leafy greens) may be those involved with the biosynthesis of aliphatic glucosinolates, which includes, but is not limited to, the cytochrome P450 mono-oxygenase family (CYP79, i.e., homomethionine N-monooxygenase), such as CYP79F1 and CYP79F2. In some embodiments, the gene editing in a plant may be CYP79F1.

In some embodiments, gene editing of target site(s) in CYP79F1 and/or CYP79F2 homologs or orthologs may be carried out by a targeted insertion/deletion approach using Cpf1 or Cas9. This approach provide spatial context and can ensure that breakage, disruption, and/or damage of protein functionality within a highly conserved and known functional region of the enzymes.

In further embodiments, gene editing of target site(s) in CYP79F1 and/or CYP79F2 homologs or orthologs occurs by a stable and targeted base-editing approach using a base editing fusion protein comprising a CRISPR-Cas effector protein and a cytidine deaminase or adenosine deaminase. This approach could serve to selectively and precisely guide base editing approaches which target specific residues.

In some embodiments, gene editing of target site(s) in a CYP79F1 gene may be carried out by a targeted insertion/deletion approach using, for example, a CRISPR-Cas effector protein (e.g., Cpf1 or Cas9). This approach can provide spatial context and can ensure that breakage, disruption, and/or damage of protein functionality, optionally within a highly conserved and known functional region of the enzymes.

In some embodiments, gene editing of target site(s) in CYP79F1 genes (e.g., *B. juncea* CYP79F1 genes) may be carried out via stable and targeted base-editing approach using a base editing fusion protein comprising a CRISPR-Cas effector protein and for example, a cytidine deaminase or adenosine deaminase. Using such an approach, specific residues may be selectively and precisely base edited.

Accordingly, as disclosed herein, targeted alteration of glucosinolate metabolism such as CYP79F1 genes can be used to reduce pungency and/or bitterness in mustard plants. In some embodiments, genes for modifying in mustard plants (e.g., leafy greens) for reducing pungency and/or bitterness may be, for example, genes encoding *B. juncea* CYP79F1 enzymes. In some embodiments, an CYP79F1 gene that may be edited to reduce pungency and/or bitterness in a mustard plant can include an CYP79F1 that encodes a polypeptide having at least 80% (e.g., about 80, 81, 82, 83, 84, 85, 86, 87, 88, 89, 90, 91, 92, 93, 94, 95, 96, 97, 98, 99, or 100%) sequence identity to any one of the amino acid sequences of SEQ ID NOs: 115, 674-679, or 782-786 or may be a gene having at least 80% sequence identity to the nucleotide sequence of SEQ ID NOs: 113,114 or 737-742. In some embodiments, an CYP79F1 gene that may be edited to reduce pungency in a mustard plant comprises the nucleotide sequence of SEQ ID NOs: 113,114 or 737-742 or encodes the amino acid sequence of SEQ ID NOs: 115, 674-679, or 782-786.

In some embodiments, a targeted deletion in a CYP79F1 gene results in an in-frame or an out-of-frame deletion. In some embodiments, a targeted deletion in a CYP79F1 gene results in an in-frame or an out-of-frame deletion that produces a premature stop codon and optionally a truncated polypeptide. In some embodiments, such a targeted deletion is a null allele. In some embodiments the null allele may be a full knockout mutant CYP79F1 allele, wherein the full knockout mutant CYP79F1 allele results in the production of a nonfunctional CYP79F1 protein Gene editing generally refers to the process of modifying the nucleotide sequence of a genome, preferably in a precise or pre-determined manner. Examples of methods of gene editing described herein include methods of using site-directed nucleases to cut deoxyribonucleic acid (DNA) at precise target locations in the genome, thereby creating single-strand or double-strand DNA breaks at particular locations within the genome. Such breaks can be and regularly are repaired by natural, endogenous cellular processes, such as homology-directed repair (HDR) and non-homologous end joining (NHEJ). These two main DNA repair processes consist of a family of alternative pathways. NHEJ directly joins the DNA ends resulting from a double-strand break, sometimes with the loss or addition of nucleotide sequence, which may disrupt or enhance gene expression. HDR utilizes a homologous sequence, or donor sequence, as a template for inserting a defined DNA sequence at the break point. The homologous sequence can be in the endogenous genome, such as a sister chromatid. Alternatively, the donor can be an exogenous nucleic acid, such as a plasmid, a single-strand oligonucleotide, a double-stranded oligonucleotide, a duplex oligonucleotide or a virus, that has regions of high homology with the nuclease-cleaved locus, but which can also contain additional sequence or sequence changes including deletions that can be incorporated into the cleaved target locus. A third repair mechanism can be microhomology-mediated end joining (MMEJ), also referred to as "Alternative NHEJ," in which the genetic outcome is similar to NHEJ in that small deletions and insertions can occur at the cleavage site. MMEJ can make use of homologous sequences of a few basepairs flanking the DNA break site to drive a more favored DNA end joining repair outcome, and recent reports have further elucidated the molecular mechanism of this process; see, e.g., Cho and Greenberg, *Nature* 518, 174-76 (2015); Kent et al., Nature Structural and Molecular Biology, *Adv. Online* (2015); Mateos-Gomez et al., *Nature* 518, 254-57 (2015); Ceccaldi et al., *Nature* 528, 258-62 (2015). In some instances, it may be possible to predict likely repair outcomes based on analysis of potential microhomologies at the site of the DNA break.

"Recombination" refers to a process of exchange of genetic information between two polynucleotides, including but not limited to, donor capture by non-homologous end joining (NHEJ) and homologous recombination. For the purposes of this disclosure, "homologous recombination (HR)" refers to the specialized form of such exchange that takes place, for example, during repair of double-strand breaks in cells via homology-directed repair (HDR) mechanisms. This process requires nucleotide sequence homology, uses a "donor" molecule as a template to repair a "target" molecule (i.e., the one that experienced the double-strand break), and is variously known as "non-crossover gene conversion" or "short tract gene conversion," because it leads to the transfer of genetic information from the donor to the target. Without wishing to be bound by any particular theory, such transfer can involve mismatch correction of heteroduplex DNA that forms between the broken target and the donor, and/or synthesis-dependent strand annealing, in which the donor is used to resynthesize genetic information that will become part of the target, and/or related processes. Such specialized HR often results in an alteration of the sequence of the target molecule such that part or all of the sequence of the donor polynucleotide is incorporated into the target polynucleotide.

Gene editing methods contemplated in various embodiments comprise engineered nucleases, designed to bind and cleave a target DNA sequence in a gene of interest, such as genes involved in glucosinolate biosynthesis or breakdown (e.g., a myrosinase, an AOP2, and/or a CYP79F1). The engineered nucleases contemplated in particular embodiments, can be used to introduce a double-strand break in a target polynucleotide sequence, which may be repaired (i) by non-homologous end joining (NHEJ) in the absence of a polynucleotide template, e.g., a donor repair template, or (ii) by homology directed repair (HDR), i.e., homologous recombination, in the presence of a donor repair template. Engineered nucleases contemplated in certain embodiments, can also be engineered as nickases, which generate single-stranded DNA breaks that can be repaired using the cell's base-excision-repair (BER) machinery or homologous recombination in the presence of a donor repair template.

Gene editing via sequence-specific nucleases is known in the art. See e.g., (1) Carroll, D. (2011) Genome engineering with zinc-finger nucleases. *Genetics*, 188, 773-82; (2) Wood, A. J. et al. (2011) Targeted gene editing across species using ZFNs and TALENs. *Science* (New York, N.Y.), 333, 307; (3) Perez-Pinera, P. et al. (2012) Advances in targeted gene editing. *Current opinion in chemical biology*, 16, 268-77, each of which is hereby incorporated by reference in its entirety.

A nuclease-mediated double-stranded DNA (dsDNA) break in the genome can be repaired by two main mechanisms: Non-Homologous End Joining (NHEJ), which frequently results in the introduction of non-specific insertions and deletions (indels), or homology directed repair (HDR), which incorporates a homologous strand as a repair template. See, e.g., Symington, L. S. and Gautier, J. (2011) *Annual Review of Genetics*, 45, 247-71, which is hereby incorporated by reference in its entirety.

When a sequence-specific nuclease is delivered along with a homologous donor DNA construct containing the desired mutations, gene targeting efficiencies are increased by 1000-fold compared to just the donor construct alone. See, e.g., Urnov et al. (2005) Highly efficient endogenous human gene correction using designed zinc-finger nucleases. *Nature*, 435, 646-51, which is hereby incorporated by reference in its entirety.

In some embodiments, the gene editing techniques of the present disclosure are used for plants that are modified using any gene editing tool, including, but not limited to: ZFNs, TALENS, CRISPR, and Meganuclease technologies. In some embodiments, the gene editing tools of the present disclosure comprise proteins or polynucleotides which have been custom designed to target and cut at specific deoxyribonucleic acid (DNA) sequences. In some embodiments, gene editing proteins are capable of directly recognizing and binding to selected DNA sequences. In other embodiments, the gene editing tools of the present disclosure form complexes, wherein nuclease components rely on nucleic acid molecules for binding and recruiting the complex to the target DNA sequence.

In some embodiments, the single component gene editing tools comprise a binding domain capable of recognizing specific DNA sequences in the genome of the plant and a nuclease that cuts double-stranded DNA. The rationale of gene editing technology taught in the present disclosure is the use of a tool that allows the introduction of site-specific mutations in the plant genome or the site-specific integration of genes.

Many methods are available for delivering genes into plant cells, e.g. transfection, electroporation, viral vectors and *Agrobacterium* mediated transfer. Genes can be expressed transiently from a plasmid vector. Once expressed, the genes generate the targeted mutation that will be stably inherited, even after the degradation of the plasmid containing the gene.

Customizable nucleases can be used to make targeted double-stranded breaks (DSB) in living cells, the repair of which can be exploited to induce desired sequence changes. Two competing pathways effect repairs in most cells, including plant cells. Repair of a nuclease-induced DSB by non-homologous end joining (NHEJ) leads to the introduction of insertion/deletion mutations (indels) with high frequencies. By contrast, DSB repair by homology directed repair (HDR) with a user-supplied "donor template" DNA can lead to the introduction of specific alterations (e.g., point mutations and insertions) or the correction of mutant sequences back to wild-type.

In some embodiments, a mustard plant, plant part, or cell may be modified by gene editing accomplished with engineered nucleases targeting one or more loci that contributes to a target gene of interest, such as genes involved in glucosinolate biosynthesis or breakdown (e.g., a myrosinase, an AOP2, and/or a CYP79F1). Without wishing to be bound to any particular theory, it is contemplated that engineered nucleases are designed to precisely disrupt one or more target genes of interest through gene editing and, once nuclease activity and specificity are validated, lead to predictable disruption of target gene expression and/or function (e.g., disruption of expression of genes involved in glucosinolate biosynthesis or breakdown (e.g., a myrosinase, an AOP2, and/or a CYP79F1), for example, in a plant, thereby reducing the pungency and/or bitterness of the plant.

The engineered nucleases described herein generate single-stranded DNA nicks or double-stranded DNA breaks (DSB) in a target sequence. Furthermore, a DSB can be achieved in the target DNA by the use of two nucleases generating single-stranded micks (nickases). Each nickase cleaves one strand of the DNA and the use of two or more nickases can create a double strand break (e.g., a staggered double-stranded break) in a target DNA sequence. In other embodiments, the nucleases are used in combination with a donor repair template, which is introduced into the target sequence at the DNA break-site via homologous recombination at a DSB.

Engineered nucleases described herein that are suitable for gene editing comprise one or more DNA binding domains and one or more DNA cleavage domains (e.g., one or more endonuclease and/or exonuclease domains), and optionally, one or more linkers contemplated herein. An "engineered nuclease" refers to a nuclease comprising one or more DNA binding domains and one or more DNA cleavage domains, wherein the nuclease has been designed and/or modified to bind a DNA binding target sequence adjacent to a DNA cleavage target sequence. The engineered nuclease may be designed and/or modified from a naturally occurring nuclease or from a previously engineered nuclease.

Illustrative examples of nucleases that may be engineered to bind and cleave a target sequence include, but are not limited to homing endonucleases (meganucleases), megaTALs, transcription activator-like effector nucleases (TALENs), zinc finger nucleases (ZFNs), and clustered regularly-interspaced short palindromic repeats (CRISPR)/Cas nuclease systems.

In some embodiments, the nucleases contemplated herein comprise one or more heterologous DNA-binding and cleavage domains (e.g., ZFNs, TALENs, megaTALs), (Boissel et al. *Nucleic Acids Res* 42:2591-2601 (2014); Christian et al. *Genetics* 186:757-761 (2010)). In some embodiments, the DNA-binding domain of a naturally-occurring nuclease may be altered to bind to a selected target site (e.g., a meganuclease that has been engineered to bind to site different than the cognate binding site). For example, meganucleases have been designed to bind target sites different from their cognate binding sites (Boissel et al. *Nucleic Acids Res* 42:2591-2601 (2014)). In some embodiments, a nuclease requires a nucleic acid sequence to target the nuclease to a target site (e.g., CRISPR/Cas).

A "TALEN" refers to an engineered nuclease comprising an engineered TALE DNA binding domain contemplated elsewhere herein and an endonuclease domain (or endonuclease half-domain thereof), and optionally comprise one or more linkers and/or additional functional domains, e.g., an end-processing enzymatic domain of an end-processing enzyme that exhibits 5-3' exonuclease, 5-3' alkaline exonuclease, 3-5'exonuclease (e.g., Trex2), 5' flap endonuclease, helicase or template-independent DNA polymerases activity. Thus, a transcription activator-like effector nuclease (TALEN) comprises a nonspecific DNA-cleaving nuclease (e.g., a Fok I cleavage domain) fused to a DNA-binding domain that can be easily engineered so that TALENs can target essentially any sequence (See, e.g., Joung and Sander, *Nature Reviews Molecular Cell Biology* 14:49-55 (2013)). Methods for generating engineered TALENs are known in the art, see, e.g., the fast ligation-based automatable solid-phase high-throughput (FLASH) system described in U.S. Ser. No. 61/610,212, and Reyon et al., *Nature Biotechnology* 30,460-465 (2012); as well as the methods described in Bogdanove & Voytas, *Science* 333, 1843-1846 (2011); Bogdanove et al., *Curr Opin Plant Biol* 13, 394-401 (2010); Scholze & Boch, *J. Curr Opin Microbiol* (2011); Boch et al., *Science* 326, 1509-1512 (2009); Moscou & Bogdanove, *Science* 326, 1501 (2009); Miller et al., *Nat Biotechnol* 29, 143-148 (2011); Morbitzer et al., *T. Proc Natl Acad Sci USA* 107, 21617-21622 (2010); Morbitzer et al., *Nucleic Acids Res* 39, 5790-5799 (2011); Zhang et al., *Nat Biotechnol* 29, 149-153 (2011); Geissler et al., *PLOS ONE* 6, e19509 (2011); Weber et al., *PLOS ONE* 6, e19722 (2011); Christian et al., *Genetics* 186, 757-761 (2010); Li et al., *Nucleic Acids Res* 39, 359-372 (2011); Mahfouz et al., *Proc Natl Acad Sci USA* 108, 2623-2628 (2011); Mussolino et al., *Nucleic Acids Res* (2011); Li et al., *Nucleic Acids Res* 39, 6315-6325 (2011); Cermak et al., *Nucleic Acids Res* 39, e82 (2011); Wood et al., *Science* 333, 307 (2011); Hockemeye et al. *Nat Biotechnol* 29, 731-734 (2011); Tesson et al., *Nat Biotechnol* 29, 695-696 (2011); Sander et al., *Nat Biotechnol* 29, 697-698 (2011); Huang et al., *Nat Biotechnol* 29, 699-700 (2011); and Zhang et al., *Nat Biotechnol* 29, 149-153 (2011); each of which is incorporated herein by reference in its entirety. In some embodiments, a TALEN that binds to and cleaves a target region of a locus that contributes to a target gene of interest that may be used to generate plants having reduced pungency and/or reduced bitterness such as genes involved in glucosinolate biosynthesis or breakdown (e.g., a myrosinase, an AOP2, and/or a CYP79F1).

In some embodiments, a plant of interest may be modified through Transcription activator-like (TAL) effector nucleases (TALENs). TALENS polypeptides comprise repeat polypeptide arms capable of recognizing and binding to specific nucleic acid regions. By engineering the polypeptide arms to recognize selected target sequences, the TAL nucleases can be use to direct double stranded DNA breaks to specific genomic regions. These breaks can then be repaired via recombination to edit, delete, insert, or otherwise modify the DNA of a host organism. In some embodiments, TALENSs are used alone for gene editing (e.g., for the deletion or disruption of a gene). In other embodiments, TALs are used in conjunction with donor sequences and/or other recombination factor proteins that will assist in the Non-homologous end joining (NHEJ) process to replace the targeted DNA region. For more information on the TAL-mediated gene editing compositions and methods of the present disclosure, see U.S. Pat. Nos. 8,440,432; 8,440,432; 8,450,471; 8,586,526; 8,586,363; 8,592,645; 8,697,853; 8,704,041; 8,921,112; and 8,912,138, each of which is hereby incorporated in its entirety.

A "megaTAL" refers to an engineered nuclease comprising an engineered TALE DNA binding domain and an engineered meganuclease, and optionally comprise one or more linkers and/or additional functional domains, e.g., an end-processing enzymatic domain of an end-processing enzyme that exhibits 5-3' exonuclease, 5-3' alkaline exonuclease, 3-5'exonuclease, 5' flap endonuclease, helicase or template-independent DNA polymerases activity. In some embodiments, a megaTAL nuclease that binds to and cleaves a target region of a locus that contributes to a target gene of interest may be used to generate mustard plants with reduced pungency and/or reduced bitterness by targeting genes involved in glucosinolate biosynthesis or breakdown (e.g., a myrosinase, an AOP2, and/or a CYP79F1).

A "TALE DNA binding domain" is the DNA binding portion of transcription activator-like effectors (TALE or TAL-effectors), which mimics plant transcriptional activators to manipulate the plant transcriptome (see e.g., Kay et al., 2007. *Science* 318:648-651). TALE DNA binding domains contemplated in particular embodiments are engineered de novo or from naturally occurring TALEs. Illustrative examples of TALE proteins for deriving and designing DNA binding domains are disclosed in U.S. Pat. No. 9,017,967, and references cited therein, which are incorporated herein by reference in their entireties.

In some embodiments, plants of interest are modified through megaTALs. In some embodiments, megaTALs are engineered endonucleases capable of targeting selected DNA sequences and inducing DNA breaks.

A "meganuclease" or "homing endonuclease" (HE) is a sequence-specific endonuclease originating from a variety of organisms such as bacteria, yeast, algae and plant organelles. A number of meganucleases are known in the art, see, e.g., WO 2012010976 (Meganuclease variants cleaving DNA target sequences of the TERT gene); U.S. Pat. Nos. 8,021,867; 8,119,361 and 8,119,381 (I-CreI meganucleases); U.S. Pat. No. 7,897,372 (I-CreI Meganuclease Variants with Modified Specificity), each of which is incorporated herein by reference in its entirety.

In some embodiments, a homing endonuclease or meganuclease is engineered to bind to, and to introduce single-stranded nicks or double-strand breaks (DSBs) in, one or more loci that contribute to a target gene of interest such as genes involved in glucosinolate biosynthesis or breakdown (e.g., a myrosinase, an AOP2, and/or a CYP79F1). "Homing endonuclease" and "meganuclease" are used interchangeably and refer to naturally-occurring nucleases or engineered meganucleases that recognize 12-45 base-pair cleavage sites and are commonly grouped into five families based on sequence and structure motifs: LAGLIDADG, GIY-YIG, HNH, His-Cys box, and PD–(D/E) XK.

Engineered HEs do not exist in nature and can be obtained by recombinant DNA technology or by random mutagenesis. Engineered HEs may be obtained by making one or more amino acid alterations, e.g., mutating, substituting, adding, or deleting one or more amino acids, in a naturally occurring HE or previously engineered HE. In some embodiments, an engineered HE comprises one or more amino acid alterations to the DNA recognition interface. Engineered HEs contemplated in particular embodiments may further comprise one or more linkers and/or additional functional domains, e.g., an end-processing enzymatic domain of an end-processing enzyme that exhibits 5-3' exonuclease, 5-3' alkaline exonuclease, 3-5'exonuclease, 5' flap endonuclease, helicase or template-independent DNA polymerases activity.

In some embodiments, a mustard plant may be modified using meganucleases. In some embodiments, meganucleases are engineered endonucleases capable of targeting selected DNA sequences and inducing DNA breaks. In some embodiments, new meganucleases targeting specific regions are developed through recombinant techniques which combine the DNA binding motifs from various other identified nucleases. In other embodiments, new meganucleases are created through semi-rational mutational analysis, which attempts to modify the structure of existing binding domains to obtain specificity for additional sequences. For more information on the use of meganucleases for genome editing, see Silva et al., 2011 Current Gene Therapy 11 pg 11-27; and Stoddard et al., 2014 Mobile DNA 5 pg 7, each of which is hereby incorporated in its entirety.

"Zinc-finger nucleases" (ZFNs) are composed of programmable, sequence-specific zinc finger DNA-binding modules (see above) linked to a nonspecific DNA cleavage domain, e.g., a Fok I cleavage domain. Methods for making and using ZFNs are known in the art, see, e.g., (Maeder et al., 2008, Mol. Cell, 31:294-301; Joung et al., 2010, Nat. Methods, 7:91-92; Isalan et al., 2001, Nat. Biotechnol., 19:656-660; Sander et al., Nat Methods. 8 (1): 67-9, 2011; Bhakta et al., Genome Res. 23 (3): 530-8, 2013). In some embodiments, the ZFNs are described in, or are generated as described in, WO 2011/017293 or WO 2004/099366, each of which is hereby incorporated in its entirety. Additional suitable ZFNs are described in U.S. Pat. Nos. 6,511,808, 6,013,453, 6,007,988, and 6,503,717 and U.S. patent application 2002/0160940, each of which is hereby incorporated in its entirety.

A "ZFN" refers to an engineered nuclease comprising one or more zinc finger DNA binding domains and an endonuclease domain (or endonuclease half-domain thereof), and optionally comprise one or more linkers and/or additional functional domains, e.g., an end-processing enzymatic domain of an end-processing enzyme that exhibits 5-3' exonuclease, 5-3' alkaline exonuclease, 3-5'exonuclease, 5' flap endonuclease, helicase or template-independent DNA polymerases activity. In some embodiments, a zinc finger nuclease (ZFN) that binds to and cleaves a target region of a locus that contributes to a target gene of interest such as genes involved in glucosinolate biosynthesis or breakdown (e.g., a myrosinase, an AOP2, and/or a CYP79F1). and thus, may be used to modify a plant to reduce its pungency and/or bitterness.

In some embodiments, targeted double-stranded cleavage is achieved using two ZFNs, each comprising an endonuclease half-domain can be used to reconstitute a catalytically active cleavage domain. In some embodiments, targeted double-stranded cleavage is achieved with a single polypeptide comprising one or more zinc finger DNA binding domains and two endonuclease half-domains.

In some embodiments, a ZFN comprises a TALE DNA binding domain as discussed herein, a zinc finger DNA binding domain, and an endonuclease domain (or endonuclease half-domain) as discussed herein. In some embodiments, a ZFN comprises a zinc finger DNA binding domain, and a meganuclease as discussed herein.

In some embodiments, the ZFN comprises a zinger finger DNA binding domain that has one, two, three, four, five, six, seven, or eight or more zinger finger motifs and an endonuclease domain (or endonuclease half-domain). Typically, a single zinc finger motif is about 30 amino acids in length. Zinc fingers motifs include both canonical $C_2H_2$ zinc fingers, and non-canonical zinc fingers such as, for example, $C_3H$ zinc fingers and $C_4$ zinc fingers.

Zinc finger binding domains can be engineered to bind any DNA sequence. Candidate zinc finger DNA binding domains for a given 3 bp DNA target sequence have been identified and modular assembly strategies have been devised for linking a plurality of the domains into a multi-finger peptide targeted to the corresponding composite DNA target sequence. Other suitable methods known in the art can also be used to design and construct nucleic acids encoding zinc finger DNA binding domains, e.g., phage display, random mutagenesis, combinatorial libraries, computer/rational design, affinity selection, PCR, cloning from cDNA or genomic libraries, synthetic construction and the like. (See, e.g., U.S. Pat. No. 5,786,538; Wu et al., PNAS 92:344-348 (1995); Jamieson et al., Biochemistry 33:5689-5695 (1994); Rebar & Pabo, Science 263:671-673 (1994); Choo & Klug, PNAS 91:11163-11167 (1994); Choo & Klug, PNAS 91:11168-11172 (1994); Desjarlais & Berg, PNAS 90:2256-2260 (1993); Desjarlais & Berg, PNAS 89:7345-7349 (1992); Pomerantz et al., Science 267:93-96 (1995); Pomerantz et al., PNAS 92:9752-9756 (1995); Liu et al., PNAS 94:5525-5530 (1997); Griesman & Pabo, Science 275:657-661 (1997); Desjarlais & Berg, PNAS 91:11-99-11103 (1994)).

Individual zinc finger motifs bind to a three or four nucleotide sequence. The length of a sequence to which a zinc finger binding domain is engineered to bind (e.g., a target sequence) will determine the number of zinc finger motifs in an engineered zinc finger binding domain. For example, for ZFNs in which the zinc finger motifs do not bind to overlapping subsites, a six-nucleotide target sequence is bound by a two-finger binding domain; a nine-nucleotide target sequence is bound by a three-finger binding domain, etc. In particular embodiments, DNA binding sites for individual zinc fingers motifs in a target site need not be contiguous, but can be separated by one or several nucleotides, depending on the length and nature of the linker sequences between the zinc finger motifs in a multi-finger binding domain.

In some embodiments, plants of interest are modified through the use of Zinc Finger Nucleases. Three variants of the ZFN technology are recognized in plant genome engineering (with applications ranging from producing single mutations or short deletions/insertions in the case of ZFN-1 and -2 techniques up to targeted introduction of new genes in the case of the ZFN-3 technique): (1) ZFN-1: Genes encoding ZFNs are delivered to plant cells without a repair template. The ZFNs bind to the plant DNA and generate site specific double-strand breaks (DSBs). The natural DNA-repair process (which occurs through nonhomologous end-joining, NHEJ) leads to site specific mutations, in one or only a few base pairs, or to short deletions or insertions. (2) ZFN-2: Genes encoding ZFNs are delivered to plant cells along with a repair template homologous to the targeted area, spanning a few kilo base pairs. The ZFNs bind to the plant DNA and generate site-specific DSBs. Natural gene repair mechanisms generate site-specific point mutations e.g. changes to one or a few base pairs through homologous recombination and the copying of the repair template. (ZFN-3): Genes encoding ZFNs are delivered to plant cells along with a stretch of DNA which can be several kilo base pairs long and the ends of which are homologous to the DNA sequences flanking the cleavage site. As a result, the DNA stretch is inserted into the plant genome in a site specific manner.

"FokI" is a type IIs restriction endonuclease that includes a DNA recognition domain and a catalytic (endonuclease) domain. The fusion proteins described herein can include all of FokI or just the catalytic endonuclease domain, e.g., amino acids 388-583 or 408-583 of GenBank Acc. No. AAA24927.1, e.g., as described in WO95/09233, Li et al., *Nucleic Acids Res.* 39 (1): 359-372 (2011); Cathomen and Joung, *Mol. Ther.* 16:1200-1207 (2008), or a mutated form of FokI as described in Miller et al. *Nat Biotechnol* 25:778-785 (2007); Szczepek et al., *Nat Biotechnol* 25:786-793 (2007); or Bitinaite et al., *Proc. Natl. Acad. Sci. USA.* 95:10570-10575 (1998). See also Tsai et al., *Nat Biotechnol.* 2014 June; 32 (6): 569-76. In some embodiments, plants of interest are modified through FokI endonucleases.

As used herein, the term "targeted base-editing system" refers to a protein, nucleic acid, or combination thereof that is capable of substituting a single nucleotide at a target site and modifying an endogenous target DNA sequence when introduced into a cell, thereby causing one or more amino acid substitutions. Numerous gene editing systems suitable for use in the methods of the present disclosure, include, but are not limited to, zinc-finger nuclease systems, TALEN systems, and CRISPR/Cas systems. In some embodiments, a nuclease-inactivated CRISPR/Cas system having a base deaminase activity is utilized for a targeted base-editing. In other aspects, a nickase is used.

In some embodiments, a "targeted base-editing system" of the invention can mediate a change in the sequence of the endogenous target gene, for example, by introducing one or more point mutations into the endogenous target sequence, such as by substituting C with T (or G with A) or A with G (or T with C) in the endogenous target sequence.

In some embodiments, the targeted base-editing system may mediate a change in the expression of the protein encoded by the endogenous target gene. In such embodiments, the targeted base-editing system may regulate the expression of the encoded protein by modifications of the endogenous target DNA sequence, or by acting on the mRNA product encoded by the DNA sequence. In some embodiments, the targeted base-editing system may result in the expression of a modified endogenous protein. In some embodiments, the modifications to the endogenous DNA sequence mediated by the targeted base-editing system result in an altered function of the modified endogenous protein as compared to the corresponding endogenous protein in an unmodified plant cell. In such embodiments, the expression level of the modified endogenous protein may be increased, decreased or may be the same, or substantially similar to, the expression level of the corresponding endogenous protein in an unmodified plant cell.

The present disclosure provides a targeted base-editing system to edit a target nucleotide sequence in the genome of a plant, comprising for example, one of the following i) a base editing fusion protein, and a guide nucleic acid; ii) an expression construct comprising a nucleotide sequence encoding a base editing fusion protein, and a guide nucleic acid; iii) a base editing fusion protein, and an expression construction comprising a nucleotide sequence encoding a guide nucleic acid; iv) an expression construct comprising a nucleotide sequence encoding a base editing fusion protein, and an expression construct comprising a nucleotide sequence encoding a guide nucleic acid; v) an expression construct comprising a nucleotide sequence encoding base editing fusion protein and a nucleotide sequence encoding guide nucleic acid; wherein the base editing fusion protein contains a CRISPR-Cas effector protein or domain thereof, and optionally a deaminase protein and/or domain, and the guide RNA can target said gene editing fusion protein to the target sequence in the plant genome. In some embodiments, a targeted base editing fusion protein comprises a nuclease-inactivated CRISPR-Cas effector domain and a cytidine deaminase domain. In some embodiments, a targeted base-editing fusion protein comprises a nuclease-inactivated CRISPR-Cas effector domain and an adenosine deaminase domain.

In some embodiments, the targeted gene-editing system described herein contains CRISPR (Clustered Regularly Interspaced Short Palindromic Repeats)/Cas (CRISPR Associated) nuclease system as a CRISPR-Cas effector domain. In some embodiments, the CRISPR/Cas system is a Class 2 system. Class 2 CRISPR/Cas systems are divided into three types: Type II, Type V, and Type VI systems. In some embodiments, the CRISPR/Cas system is a Class 2 Type II system, utilizing the Cas9 protein. In some embodiments, the site-directed modifying polypeptide is a Cas9 DNA endonuclease (or variant thereof).

In some embodiments, a CRISPR/Cas system is a Class 2 Type V system comprising Cas12 proteins (e.g., Cas12a (also known as Cpf1), Cas12b (also known as $C_2c1$), Cas12c (also known as $C_2c3$), Cas12d (also known as CasY), and Cas12e (also known as CasX)). In some embodiments, a site-directed modifying polypeptide is a Cas12 DNA endonuclease (or variant thereof). In some embodiments, a CRISPR/Cas system is a Class 2 and Type VI system, utilizing the Cas13 proteins (e.g., Cas13a (also known as $C_2c2$), Cas13b, and Cas13c). (See, Pyzocha et al., *ACS Chemical Biology,* 13 (2), 347-356). In some embodiments, a site-directed modifying polypeptide is a Cas13 RNA riboendonuclease.

A Cas polypeptide refers to a polypeptide that can interact with a guide molecule (e.g., gRNA, sgRNA) and, in concert with the guide molecule, home or localize to a target nucleic acid sequences (e.g., DNA target sequence or RNA target sequence). Cas polypeptides include naturally occurring Cas proteins and engineered, altered, or otherwise modified Cas proteins that differ by one or more amino acid residues from a naturally-occurring Cas sequence.

A guide RNA (gRNA) comprises two segments, a DNA-binding segment and a protein-binding segment. In some embodiments, the protein-binding segment of a gRNA is comprised in one RNA molecule and the DNA-binding segment is comprised in another separate RNA molecule. Such embodiments are referred to herein as "double-molecule gRNAs" or "two-molecule gRNA" or "dual gRNAs." In some embodiments, the gRNA is a single RNA molecule and is referred to herein as a "single-guide RNA" or an "sgRNA." The term "guide RNA" or "gRNA" is inclusive, referring both to two-molecule guide RNAs and sgRNAs. FIGS. 1-5 provide illustrations of spacer sequences from guide nucleic acids aligned with myrosinase gene sequences, AOP2 gene sequences and CYP79F1 gene sequences.

The protein-binding segment of a gRNA comprises, in part, two complementary stretches of nucleotides that hybridize to one another to form a double stranded RNA duplex (dsRNA duplex), which facilitates binding to the Cas protein. The nucleic acid-binding segment (or "nucleic acid-binding sequence") of a gRNA comprises a nucleotide sequence that is complementary to and capable of binding to a specific target nucleic acid sequence. The protein-binding segment of the gRNA interacts with a Cas polypeptide and the interaction of the gRNA molecule and site-directed modifying polypeptide results in Cas binding to the endogenous nucleic acid sequence and produces one or more modifications within or around the target nucleic acid sequence. The precise location of the target modification site is determined by both (i) base-pairing complementarity between the gRNA and the target nucleic acid sequence; and (ii) the location of a short motif, referred to as the protospacer adjacent motif (PAM), in the target DNA sequence (referred to as a protospacer flanking sequence (PFS) in target RNA sequences). The PAM/PFS sequence is required for Cas binding to the target nucleic acid sequence. A variety of PAM/PFS sequences are known in the art and are suitable for use with a particular Cas endonuclease (e.g., a Cas9 endonuclease) (See e.g., *Nat Methods.* 2013 November; 10 (11): 1116-1121 and *Sci Rep.* 2014; 4:5405). In some embodiments, the PAM sequence is located within 50 base pairs of the target modification site in a target DNA sequence. In some embodiments, the PAM sequence is located within 10 base pairs of the target modification site in a target DNA sequence. The DNA sequences that can be targeted by this method are limited only by the relative distance of the PAM sequence to the target modification site and the presence of a unique 20 base pair sequence to mediate sequence-specific, gRNA-mediated Cas binding. In some embodiments, the PFS sequence is located at the 3' end of the target RNA sequence. In some embodiments, the target modification site is located at the 5' terminus of the target locus. In some embodiments, the target modification site is located at the 3' end of the target locus. In some embodiments, the target modification site is located within an intron or an exon of the target locus.

In some embodiments, the present disclosure provides a polynucleotide encoding a gRNA. In some embodiments, a gRNA-encoding nucleic acid is comprised in an expression vector, e.g., a recombinant expression vector. In some embodiments, the present disclosure provides a polynucleotide encoding a site-directed modifying polypeptide. In some embodiments, the polynucleotide encoding a site-directed modifying polypeptide is comprised in an expression vector, e.g., a recombinant expression vector.

In some embodiments, the addition of a uracil DNA glycosylase (UGI) domain can further increased the base-editing efficiency. In some embodiments, a targeted base-editing system of the invention further comprises a base excision repair (BER) inhibitor. Cellular DNA-repair response to the presence of a U:G pairing in DNA may be responsible for a decrease in nucleobase editing efficiency in plant cells. Uracil DNA glycosylase catalyzes removal of uracil from DNA in plant cells, which may initiate base excision repair, such that the U:G pair is reversed to C:G. In some embodiments, the BER inhibitor is an uracyl glycosylase inhibitor or an active domain thereof.

In some embodiments, the BER inhibitor is an inhibitor of uracil DNA glycosylase (UDG). In some embodiments, the BER inhibitor is an inhibitor of UDG. In some embodiments, the BER inhibitor is a polypeptide inhibitor. In some embodiments, the BER inhibitor is a protein that binds single-stranded DNA. For example, the BER inhibitor may be a *Erwinia tasmaniensis* single-stranded binding protein. In some embodiments, the BER inhibitor is a protein that binds uracil. In some embodiments, the BER inhibitor is a protein that binds uracil in DNA. In some embodiments, the BER inhibitor is a catalytically inactive UDG or binding domain thereof. In some embodiments, the BER inhibitor is a catalytically inactive UDG or binding domain thereof that does not excise uracil from the DNA. Other proteins that are capable of inhibiting (e.g., sterically blocking) UDG are within the scope of this disclosure. Additionally, any proteins that block or inhibit base-excision repair as also within the scope of this disclosure.

Base excision repair may be inhibited by molecules that bind the edited strand, block the edited base, inhibit uracil DNA glycosylase, inhibit base excision repair, protect the edited base, and/or promote fixing of the non-targeted strand. Accordingly, the use of the BER inhibitor described herein can increase the editing efficiency of a cytidine deaminase that is capable of catalyzing a C to U change.

In some embodiments, a base editing system of the invention can comprise the following domains; i) the CRISPR-Cas protein (dCas9 or nCas9) and ii) the cytidine deaminase, which can be fused to or linked to a BER inhibitor (e.g., an inhibitor of uracil DNA glycosylase).

"Uracil-DNA glycosylase" (UDG) is an enzyme that reverts mutations in DNA. The most common mutation is the deamination of cytosine to uracil. UDG repairs these mutations and UDG is crucial in DNA repair. Various uracil-DNA glycosylases and related DNA glycosylases (EC) are present such as uracil-DNA glycosylase, thermophilic uracil-DNA glycosylase, G: T/U mismatch-specific DNA glycosylase (Mug), and single-strand selective monofunctional uracil-DNA glycosylase (SMUG1).

Uracil DNA glycosylases remove uracil from DNA, which can arise either by spontaneous deamination of cytosine or by the misincorporation of dU opposite dA during DNA replication. The prototypical member of this family is *E. coli* UDG, which was among the first glycosylases discovered. Four different uracil-DNA glycosylase activities have been identified in mammalian cells, including UNG, SMUG1, TDG, and MBD4, which vary in substrate specificity and subcellular localization. SMUG1 prefers single-stranded DNA as substrate, but also removes U from double-stranded DNA. In addition to unmodified uracil, SMUG1 can excise 5-hydroxyuracil, 5-hydroxymethyluracil and 5-formyluracil bearing an oxidized group at ring C5. [13] TDG and MBD4 are strictly specific for double-stranded DNA. TDG can remove thymine glycol when present opposite guanine, as well as derivatives of U with modifications at carbon 5.

TDG and SMUG1 are the major enzymes responsible for the repair of the U:G mispairs caused by spontaneous cytosine deamination, whereas uracil arising in DNA through dU misincorporation is mainly dealt with by UNG.

MBD4 is thought to correct T: G mismatches that arise from deamination of 5-methylcytosine to thymine in CpG sites.

Uracil arising in DNA either from misincorporation of dUMP or from deamination of cytosine is actively removed through the multistep base excision repair (BER) pathway. BER of uracil is initiated by a uracil DNA glycosylase (UDG) activity that cleaves the N-glycosidic bond and excises uracil as a free base, generating an abasic (apurinic/apyrimidinic, AP) site in the DNA. Repair is completed through subsequent steps that include incision at the AP site, gap tailoring, repair synthesis, and ligation.

In some embodiments, the addition of a Uracil-DNA glycosylase (UDG) such as uracil N-glycosylase (UNG) can induce various mutations at targeted base. In some embodiments, the targeted base-editing system further comprises a Uracil-DNA glycosylase (UDG). Cellular DNA-repair response to the presence of a U:G pairing in DNA may be responsible for a decrease in nucleobase editing efficiency in plant cells. Uracil DNA glycosylase catalyzes removal of uracil from DNA in plant cells, which may initiate base excision repair, such that the U:G pair is reversed to C:G. In some embodiments, removal of uracil from DNA in plant cells are not always reversed to C for C:G paring, but randomized to other bases such as T, A, and G.

In some embodiments, a Uracil-DNA glycosylase (UDG) may be fused to the targeted base editing system of this invention to introduce a stable and targeted, but randomized single nucleotide substitution in a target gene of interest such as a gene encoding an enzyme involved in glucosinolate biosynthesis or breakdown (e.g., myrosinase, CYP79F1 and AOP2).

The use of the UDG described herein can increase the base randomization in a targeted single nucleotide of a target gene, for example, a gene encoding an enzyme involved in glucosinolate biosynthesis or breakdown (e.g., myrosinase, CYP79F1 and AOP2) . . .

In some embodiments, a UDG is provided in cis. In some embodiments, a UDG is provided in trans. In some embodiments, a UDG is fused to a base editor (or a base editing system) described in the present disclosure. Io other embodiments, a UDG trigger a stall DNA replication for base randomization. In other embodiments, a UDG triggers a DNA repair through DNA replication, thereby including base randomization. In further embodiments, naturally occurring UDG variants can be used as a UDG domain. In further embodiments, non-naturally occurring UDG variants can be used as a UDG domain. In further embodiments, a UDG can be genetically engineered to enhance a functional UDG activity.

A "nuclear localization signal" (NLS), or any other organelle targeting signal, can be further required to ensure proper targeting of the complex. The present disclosure relate to modifying a cytosine in a target locus of interest, whereby the target locus is within a plant cell. In order to improve targeting of the CRISPR-Cas protein and/or the cytidine deaminase protein or catalytic domain thereof used in the methods of the present disclosure to the nucleus, it may be advantageous to provide one or both of these components with one or more nuclear localization sequences (NLSs).

In some embodiments, the NLSs can be heterologous to the proteins to be located to the nuclease. In general, NLS consists of one or more short sequences of positively charged lysine or arginine exposed on the surface of a protein, but other types of NLS are also known in the art. In some embodiments, the N-terminus of the gene editing fusion protein comprises an NLS with an amino acid sequence. In some embodiments, the C-terminus of the gene-editing fusion protein comprises an NLS.

A base editing fusion protein may also include other localization sequences, such as cytoplasmic localization sequences, chloroplast localization sequences, mitochondrial localization sequences, and the like, depending on the location of the DNA to be edited. In order to obtain efficient expression in plants, in some embodiments, the nucleotide sequence encoding the base editing fusion protein is codon optimized for the plant to be base edited.

Codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at kazusa.orjp/codon/ and these tables can be adapted in a number of ways. See Nakamura, Y., et al. "Codon usage tabulated from the international DNA sequence databases: status for the year 2000" *Nucl. Acids Res.* 28:292 (2000).

In some embodiments, a codon-optimized nucleotide sequence encoding the base editing fusion protein is provided herein. In some embodiments, the guide RNA is a single guide RNA (sgRNA). Methods of constructing suitable sgRNAs according to a given target sequence are known in the art. See e.g., Wang, Y. et al. *Nat. Biotechnol.* 32, 947-951 (2014); Shan, Q. et al. *Nat. Biotechnol.* 31, 686-688 (2013); Liang, Z. et al. *J Genet Genomics.* 41, 63-68 (2014).

Any plant or plant part comprising a glucosinolate pathway comprising one or more of a myrosinase, a CYP79F1 or an AOP2 may be useful with this invention. In some embodiments, a plant or plant part useful with the invention may be in the order Brassicales. In some embodiments, a plants useful with the invention may be in the Brassicaceae family, in the Moringaceae family (e.g., Moringa spp.) and/or in the Caricaceae family (e.g., *C. papaya*). In some embodiments, the plants are species within the genus *Brassica* including, but are not limited to, B. *balearica* (Mallorca cabbage), B. *carinata* (Abyssinian mustard or Abyssinian cabbage, used to produce biodiesel), B. *elongata* (elongated mustard), B. *fruticulosa* (Mediterranean cabbage), B. hilarionis (St Hilarion cabbage), *B. juncea* (Indian mustard, brown and leaf mustards, Sarepta mustard), *B. napus* (rapeseed, canola, rutabaga, Siberian kale (swede, swede turnip, Swedish turnip)), B. narinosa (broadbeaked mustard), *B. nigra* (black mustard), *B. oleracea* (kale, cabbage, collard greens, broccoli, cauliflower, kailan, Brussels sprouts, kohlrabi), B. perviridis (tender green, mustard spinach), *B. rapa* (syn. *B. campestris*) (Chinese cabbage, turnip, rapini, komatsuna), B. *rupestris* (brown mustard), and B. *tournefortii* (Asian mustard).

In some embodiments, a plant or plant part is a mustard plant. Example mustard plants (or parts there of) include, but are not limited to, a kale plant or part thereof, a collard plant or part thereof, a spinach plant or part thereof, a cabbage plant or part thereof, a beet plant or part thereof, a watercress plant or part thereof, a lettuce plant or part thereof (e.g. romaine), a swiss chard plant or part thereof, an arugula plant or part thereof, an endive plant or part thereof, a bok choy plant or part thereof, a rutabaga plant or part thereof, a turnip plant or part thereof, a mustard plant or part thereof, a cabbage plant or part thereof, a broccoli plant or part thereof, a cauliflower plant or part thereof, a Brussels sprout plant or part thereof, a radish plant or part thereof, or a kohlrabi plant or part thereof. In some embodiments, a mustard plant or part thereof may include, but is not limited to, *Brassica oleracea* (e.g., *B. oleracea* var. *oleracea, B. oleracea* var. *capitata, B. oleracea* var. *botrytis, B. oleracea* var. *gemmifera, B. oleracea* var. *sabauda, B. oleracea* var. *gongyiodes, B. oleracea* var. *italic, B. oleracea* var. *sabellica, B. oleracea* var. *acephala), Brassica juncea, Brassica rapa* (*B. rapa* subsp. *pekinensis, B. rapa* subsp. *Chinensis, B. rapa* subsp. *rapa), Brassica napas, Brassica carinata, Brassica campestris Brassica nigra* or *Raphanus raphanistrum* (e.g., *Raphanus* raphanistrum subsp. *Sativus*).

The methods for targeted gene-editing system as described herein can be used to confer desired traits on essentially any plant. A wide variety of plants and plant cell systems may be engineered for the desired physiological and agronomic characteristics described herein using the nucleic acid constructs of the present disclosure and the various transformation methods. In preferred embodiments, target plants and plant cells for gene editing include, but are not limited to, Brassicaceae plants including, but are not limited to, B. *balearica* (Mallorca cabbage), *B. carinata* (Abyssinian mustard or Abyssinian cabbage, used to produce biodiesel), B. *elongata* (elongated mustard), *B. fruticulosa* (Mediterranean cabbage), B. hilarionis (St Hilarion cabbage), *B. juncea* (Indian mustard, brown and leaf mustards, Sarepta mustard), *B. napus* (rapeseed, canola, rutabaga, Siberian kale (swede, swede turnip, Swedish turnip)), B. narinosa (broadbeaked mustard), *B. juncea, B. rapa B. nigra* (black mustard), *B. oleracea* (kale, cabbage, collard greens, broccoli, cauliflower, kailan, Brussels sprouts, kohlrabi), B. perviridis (tender green, mustard spinach), *B. carinata, B. campestris, B. rapa* (syn. *B. campestris*) (Chinese cabbage, turnip, rapini, komatsuna), B. *rupestris* (brown mustard), and B. *tournefortii* (Asian mustard) or *Raphanus* raphanistrum.

The present disclosure provides methods for targeted editing in a plant cell, tissue, organ or plant. In one aspect, the present disclosure provides methods for producing a gene-edited plant by transient expression of a gene editing system. The present disclosure teaches a gene-edited plants that is also transgene-free without any integration of foreign DNAs.

The present invention also provides a method of producing gene edited plants by a DNA-free delivery using RNP-mediated transfection of editing tools and regeneration of protoplasts.

In some embodiments, the targeted gene-editing system as described herein is used to introduce targeted mutations, such as insertions, deletions, or substitutions, thereby causing a nonsense mutation (e.g., premature stop codon) or a missense mutation (e.g., encoding different amino acid residue). This is of interest where the single nucleotide mutations in certain endogenous genes can confer or contribute to a desired trait.

The methods described herein result in the generation of gene-edited plants that have one or more desirable traits compared to the wild type plant.

In some embodiments, non-transgenic gene-edited plants, plant parts, or cells are obtained, in that no exogenous DNA sequence is incorporated into the genome of any of the plant cells of the plant. In such embodiments, the gene-edited plants are non-transgenic. Where only the modification of an endogenous gene is ensured and no foreign genes are introduced or maintained in the plant genome, the resulting genetically modified crops contain no foreign genes and can thus basically be considered non-transgenic.

In some embodiments, modification of the target sequence can be accomplished simply by introducing or producing the base editing fusion protein and guide nucleic in plant cells, and the modification can be stably inherited without the need of stably transformation of plants with the base editing system.

In some embodiments, the polynucleotides are delivered into the cell by a DNA virus (e.g., a geminivirus) or an RNA virus (e.g., a tobravirus). In other embodiments, the introducing steps include delivering to the plant cell a T-DNA containing one or more polynucleotide sequences encoding the CRISPR-Cas protein, the cytidine deaminase and the guide nucleic acid, where the delivering is via *Agrobacterium*. The polynucleotide sequence encoding the components of the cytidine deaminase coupled CRISPR/Cas system can be operably linked to a promoter, such as a constitutive promoter (e.g., a cauliflower mosaic virus 35S promoter), or a cell specific or inducible promoter in a plant cell of interest described herein. In other embodiments, the polynucleotide is introduced by microprojectile bombardment.

In some embodiments, introduction of a nucleic acid may be performed in the absence of a selective pressure, thereby avoiding the integration of exogenous nucleotide sequences in the plant genome. In some embodiments, the introduction comprises transforming the base editing system into isolated plant cells or tissues, and then regenerating the transformed plant cells or tissues into an intact plant. Preferably, the regeneration is performed in the absence of a selective pressure, i.e., no selective agent against the selective gene carried on the expression vector is used during the tissue culture. Without the use of a selective agent, the regeneration efficiency of the plant can be increased to obtain a modified plant that does not contain exogenous nucleotide sequences.

In some embodiments, a base editing system can be introduced into plants by any methods known in the art or later developed, including but not limited to particle bombardment, PEG-mediated protoplast transformation, *Agrobacterium*-mediated transformation, plant virus-mediated transformation, pollen tube, and ovary injection.

In some embodiments, the gene editing system of the present disclosure can be transformed to a particular site on an intact plant, such as leaf, shoot tip, pollen tube, young ear, or hypocotyl. This is particularly suitable for the transformation of plants that are difficult to regenerate by tissue culture. In some embodiments, proteins expressed in vitro and/or RNA molecules transcribed in vitro are directly transformed into the plant. The proteins and/or RNA molecules are capable of achieving gene-editing in plant cells, and are subsequently degraded by the cells to avoid the integration of exogenous nucleotide sequences into the plant genome.

In some embodiments, the target sequence is associated with plant traits such as desired traits, and thereby the gene editing results in the plant having altered traits relative to a wild type plant. In the present disclosure, the target sequence to be modified may be located anywhere in the genome, for example, within a functional gene such as a protein-coding gene or, for example, may be located in a gene expression regulatory region such as a promoter region or an enhancer region, and thereby accomplish the functional modification of said gene or accomplish the modification of a gene expression.

In some embodiments, the method further comprises obtaining progeny of the gene-edited plant, which may also be non-transgenic. In a further aspect, the disclosure also provides a gene-edited plant or progeny thereof or parts thereof, wherein the plant is obtained by the method described above.

In some aspects, the present disclosure also provides a plant breeding method comprising crossing a first gene-edited plant obtained by the above-mentioned method of the present disclosure with a second plant not containing said genetic modification, thereby introducing said genetic modification into said second plant. In some embodiments, a first non-transgenic plant comprising a first edited gene as described herein and a second non-transgenic plant comprising a second edited gene as described herein may be crossed with one another, wherein the progeny comprising are selected that comprise both the first and the second edited gene. Thus, for example, a first non-transgenic plant comprising a non-natural mutation in a myrosinase gene (one or more myrosinase genes) may be crossed with a second non-transgenic plant comprising a non-natural mutation in an AOP2 gene (one or more AOP2 genes) and/or a CYP79F1 gene (one or more CYP79F1 genes) and the progeny comprising both the non-natural mutation in the myrosinase gene and the AOP2 gene and/or CYP79F1 gene are selected.

In some embodiments, the methods can include a step of regenerating a plant from the plant cell. In further embodiments, the methods include cross breeding the plant to obtain a genetically desired plant lineage. As an example, a plant of the invention may be cross bred with another plant of the present invention to provide a progeny plant comprising a non-natural mutation in one or more myrosinase genes, one or more CYP79F1 genes and/or one or more AOP2 genes. As one of skill in the art would understand plants comprising other desirable genes may be crossed into plants of this invention.

The present invention is directed to methods and compositions for producing a plant or part thereof (e.g., a Brassicales plant or part thereof) having reduced pungency and/or bitterness in flavor and/or odor. In some embodiments, the present invention provides methods and compositions for producing a mustard plant having reduced pungency and/or bitterness in flavor and/or odor. Accordingly, the present invention provides a mustard plant (e.g., Brassicaceae, e.g., *Brassica* spp), a plant in the Moringaceae family and/or a plant in the Caricaceae family, or part thereof, comprising at least one non-natural mutation in an endogenous gene encoding a cytochrome P450 mono-oxygenase (i.e., CYP79F1, homomethionine N-monooxygenase; EC 1.14.14.42), an endogenous gene encoding a 2-oxo acid-dependent dioxygenase (i.e., AOP2, 2-oxoglutarate-dependent dioxygenase; EC 1.14.11.M8) and/or an endogenous gene encoding a myrosinase (i.e., glucosinolase, thioglucosidase (e.g., β-thioglucosidase), thioglucoside glucohydrolase; EC 3.2.1.147 (EC 3.2.3.1 transferred to 3.2.1.147)). In some embodiments, the mustard plant or part thereof comprising at least one non-natural mutation in an endogenous gene exhibits a reduction in activity, e.g., the endogenous gene encoding a CYP79F1, the endogenous gene encoding the AOP2, and/or the endogenous gene encoding the myrosinase is reduced in transcription activity or translation activity (e.g., a reduced amount of protein produced (e.g., reduced by about 5, 10, 15, 20, 25, 30, 35, 40, 45, 50 55, 60, 65, 70, 75, 80, 85, 90, 95, or 100%) and/or the protein produced by the endogenous gene is reduced in activity (e.g., reduced by about 5, 10, 15, 20, 25, 30, 35, 40, 45, 50 55, 60, 65, 70, 75, 80, 85, 90, 95, or 100% in activity)).

In some embodiments, a mustard plant or part thereof comprising at least one non-natural mutation in an endogenous gene exhibits reduced hydrolysis of glucosinolates and reduced pungency and/or reduced bitterness in taste and aroma as compared to a plant (or part thereof) when grown under the same environmental conditions. In some embodiments, a mustard plant or part thereof comprising at least one non-natural mutation in an endogenous gene encoding myrosinase exhibits reduced hydrolysis of glucosinolates. As used herein "reduced hydrolysis of glucosinolates" refers to reduced production of thiocyanates or reduced amounts of thiocyanates, optionally wherein the isothiocyanate is allyl isothiocyanate, and/or refers to reduced hydrolysis of sinigrin (i.e., allylglucosinolate or 2-propenylglucosinolate)) and results in reduced production of glucose.

In some embodiments, a mustard plant or part thereof comprising at least one non-natural mutation in an endogenous gene exhibits reduced amounts or reduced production of alkenyl glucosinolates, wherein the mustard plant or part thereof exhibits reduced pungency and/or reduced bitterness in taste and aroma as compared to a plant when grown under the same environmental conditions. In some embodiments, a mustard plant or part thereof comprising at least one non-natural mutation in an endogenous gene encoding an AOP2 exhibits reduced amounts or reduced production of alkenyl glucosinolates as compared to a plant (or part thereof) when grown under the same environmental conditions.

In some embodiments, a mustard plant or part thereof comprising at least one non-natural mutation in an endogenous gene exhibits reduced amounts/production of aliphatic glucosinolates, wherein the mustard plant or part thereof exhibits reduced pungency and/or reduced bitterness in taste and aroma as compared to a plant (or part thereof) when grown under the same environmental conditions. In some embodiments, a mustard plant or part thereof comprising at least one non-natural mutation in an endogenous gene encoding a CYP79F1 exhibits reduced amounts or reduced production of alkenyl glucosinolates as compared to a plant (or part thereof) when grown under the same environmental conditions.

In some embodiments, a mustard plant of this invention exhibits reduced pungency as compared to a plant not comprising the same mutation and grown under the same environmental conditions. In some embodiments, a mustard plant of the invention exhibits reduced bitterness as compared to a plant not comprising the same mutation when grown under the same environmental conditions. In some embodiments, a mustard plant of the invention exhibits reduced pungency and reduced bitterness. In some embodiments, a mustard plant of the invention comprises a mutation in at least one myrosinase gene and exhibits reduced bitterness. In some embodiments, a mustard plant of the invention comprises a mutation in at least one AOP2 gene and exhibits reduced pungency and reduced bitterness as compared to a plant not comprising the same mutation and grown under the same environmental conditions. In some embodiments, a mustard plant of the invention comprises a mutation in at least one CYP79F1 gene and exhibits reduced pungency and reduced bitterness as compared to a plant not comprising the same mutation and grown under the same environmental conditions.

The present invention further provides a mustard plant or part thereof (e.g., a plant cell) having reduced pungency or bitterness in flavor or aroma (e.g., reduced hydrolysis of glucosinolates and/or reduced amounts/production of alkenyl glucosinolates and/or aliphatic glucosinolates) (compared to a plant not comprising the same mutation and grown under the same environmental conditions) comprising at least one non-natural mutation an endogenous myrosinase gene, an endogenous AOP2 gene and/or an endogenous CYP79F1 gene, wherein the at least one mutation is a substitution, insertion or a deletion that is introduced using an editing system that comprises a nucleic acid binding domain that binds to a target site in the endogenous myrosinase gene, in the endogenous AOP2 gene or in the endogenous CYP79F1 gene.

Accordingly, in some embodiments, a mustard plant of this invention exhibits reduced pungency. In some embodiments, a mustard plant of the invention exhibits reduced bitterness. In some embodiments, a mustard plant of the invention exhibits reduced pungency and reduced bitterness. In some embodiments, a mustard plant of the invention comprises a mutation in at least one myrosinase gene and exhibits reduced bitterness. In some embodiments, a mustard plant of the invention comprises a mutation in at least one AOP2 gene and exhibits reduced pungency and reduced bitterness. In some embodiments, a mustard plant of the invention comprises a mutation in at least one CYP79F1 gene and exhibits reduced pungency and reduced bitterness. Reduced pungency and reduced bitterness is as compared to a control plant that does not comprise the same mutation and is grown under the same environmental conditions.

In some embodiments, the at least one non-natural mutation is a dominant-negative allele, semi-dominant allele, weak loss of function allele, null allele, a hypermorphic mutation or a hypomorphic mutation. In some embodiments, the at least one non-natural mutation is a null allele. In some embodiments, the null allele is a full knockout mutant CYP79F1 allele, a full knockout mutant AOP2 allele and/or a full knockout mutant myrosinase allele. As used herein, a "full knockout mutant allele" results in the production of a nonfunctional protein or no production of the protein encoded by the at least one non-natural mutation, e.g., production of a nonfunctional CYP79F1 protein or no production of the CYP79F1, production of a nonfunctional AOP2 protein or no production of a AOP2 protein, and/or production of a nonfunctional myrosinase protein or no production of a myrosinase protein.

The mutation in a myrosinase gene, an AOP2 gene, or a CYP79F1 gene of a mustard plant or part thereof (including, e.g., a plant cell) may be any type of mutation, including a base substitution, a deletion and/or an insertion. In some embodiments, a non-natural mutation is a point mutation. In some embodiments, a non-natural mutation may be a substitution of at least one base pair, a deletion of at least one base pair, or an insertion of at least one base pair. In some embodiments, a non-natural mutation may comprise a base substitution to an A, a T, a G, or a C. In some embodiments, a base substitution may produce a premature stop codon, thereby producing no protein or a truncated protein, optionally wherein the truncated protein is non-functional. In some embodiments, a deletion of a base may result in an in-frame or out of frame mutation, optionally wherein the in-frame or out of frame mutation results in a premature stop codon. In some embodiments, a mutation in a gene that results in a premature stop codon produces no polypeptide or a produces a non-functional polypeptide, optionally wherein the non-functional polypeptide is a truncated polypeptide.

In some embodiments, a mutation may comprise a deletion of at least 1 base pair to about 1000, 1500, 2000, or 2500 base pairs or more of a myrosinase gene (e.g., 1, 3, 6, 9, 15, 20, 30, 40, 50, 100, 150, 200, 300, 400, or 500 base pairs to about 600, 700, 800, 900, 1000, 1500, 2000 or 2500 base pairs or more, or any range or value therein, optionally wherein the deleted base pairs are consecutive base pairs). In some embodiments, the deletion in a myrosinase gene may result in an in-frame or out of frame mutation, optionally wherein the in-frame or out of frame mutation results in a premature stop codon. In some embodiments, the deletion may be a deletion of the full length of the myrosinase gene. In some embodiments, the deletion is in the 5' end of the myrosinase gene. In some embodiments, a deletion useful with this invention may result in the production of no myrosinase protein by the gene comprising the deletion or may result in a truncated myrosinase protein that is non-functional (e.g., a null mutation or null allele), optionally wherein the truncation of the protein comprises a truncation of at least about 50 to about 300 consecutive amino acid residues or more from the C-terminal end of the protein (e.g., the C-terminal amino acid residue of the polypeptide through to about 50 to about 300 consecutive amino acid residues) (e.g., about 50, 55, 60, 65, 70, 75, 80, 85, 90, 95, 100, 120, 140, 160, 180, 200, 220, 240, 260, 280, 300 or more consecutive amino acid residues). A plant useful with this invention may comprise multiple loci encoding myrosinase polypeptides. In some embodiments, one or two or more of the multiple loci (e.g., 2, 3, 4, 5, 6, 7, 8, 9, 10, 11, 12, 13, or more) or all loci may be edited to comprise a non-natural mutation as described herein.

In some embodiments, a non-natural mutation comprising a base substitution in a myrosinase gene may produce a premature stop codon, wherein the premature stop codon results in production of no myrosinase protein or a truncated myrosinase protein (e.g., a null mutation or null allele) by the mutated myrosinase gene, optionally wherein the truncated myrosinase protein is non-functional. In some embodiments, a truncated myrosinase polypeptide resulting from a base substitution in the myrosinase gene comprises a truncation of at least about 50 to about 300 consecutive amino acid residues or more from the C-terminal end of the protein (e.g., the C-terminal amino acid residue of the polypeptide through to about 50 to about 300 consecutive amino acid residues) (e.g., about 50, 55, 60, 65, 70, 75, 80, 85, 90, 95, 100, 120, 140, 160, 180, 200, 220, 240, 260, 280, 300 or more consecutive amino acid residues).

In some embodiments, at least one non-natural mutation in a myrosinase gene (e.g., a deletion of three or more consecution base pairs or a substitution of one or more base pairs) results in a deletion of at least one amino acid residue from the myrosinase polypeptide produced from the mutated myrosinase gene (e.g., at least 1, 2, 3, 4, 5, 6, 7, 8, 9, 10, 20, 30, 40, 50, 60, 70, 80, 90, 100, 110, 120, 130, 140, 150, 160, 170, 180, 190, 200, 220, 250, 300, 320, 350, 360, 370, 380, 390, 400, 410, 420, 440, 445, 450, 451, 452, 453, 454, 455, 456, 457, 458, 459, or 460 amino acids, or any range or value therein). In some embodiments, the deletion in the myrosinase gene results in a deletion of two or more consecutive amino acid residues from the myrosinase polypeptide.

In some embodiments, a plant may comprise one or more (e.g., 1, 2, 3, 4, 5, 6, 7, 8, 9, 10, 11, 12, 13, or more), or two or more endogenous myrosinase genes (e.g., 2, 3, 4, 5, 6, 7, 8, 9, 10, 11, 12, 13, or more). In some embodiments, a plant or part thereof of this invention comprising one or more endogenous myrosinase genes may comprise a non-natural mutation in at least one endogenous myrosinase gene, wherein the mutation results in the production of a reduced amount of myrosinase or no myrosinase and a plant or part thereof having reduced pungency. In some embodiments, a plant or part thereof of this invention comprising one or more endogenous myrosinase genes may comprise a non-natural mutation one endogenous myrosinase gene, wherein the mutation results in the production of a reduced amount of myrosinase or no myrosinase and a plant or part thereof having reduced pungency. In some embodiments, a plant or part thereof of this invention may comprise a non-natural mutation in two endogenous myrosinase genes, wherein the mutation in the two genes results in the production of a reduced amount of myrosinase or no myrosinase, and a plant or part thereof having reduced pungency. In some embodiments, a plant or part thereof of this invention may comprise a non-natural mutation in three endogenous myrosinase genes, wherein the mutation in the three genes results in the production of a reduced amount of myrosinase or no myrosinase, and a plant or part thereof having reduced pungency. In some embodiments, a plant or part thereof of this invention may comprise a non-natural mutation in four endogenous myrosinase genes, wherein the mutation in the four genes results in the production of a reduced amount of myrosinase or no myrosinase, and a plant or part thereof having reduced pungency. In some embodiments, a plant or part thereof of this invention may comprise a non-natural mutation in five endogenous myrosinase genes, wherein the mutation in the five genes results in the production of a reduced amount of myrosinase or no myrosinase, and a plant or part thereof having reduced pungency. In some embodiments, a plant or part thereof of this invention may comprise a non-natural mutation in six endogenous myrosinase genes, wherein the mutation in the six genes results in the production of a reduced amount of myrosinase or no myrosinase, and a plant or part thereof having reduced pungency. In some embodiments, a plant or part thereof of this invention may comprise a non-natural mutation in 7, 8, 9, 10, 11, 12 or 13 or more endogenous myrosinase genes, wherein the mutation in each of the 7, 8, 9, 10, 11, 12 or 13 or more genes results in the production of a reduced amount of myrosinase or no myrosinase, and a plant or part thereof having reduced pungency. A reduction in pungency is as compared to a control plant that does not comprise the same mutation and is grown under the same environmental conditions.

In some embodiments, an endogenous gene encoding myrosinase comprises a nucleotide sequence having at least 80% sequence identity (e.g., about 80, 81, 82, 83, 84, 85, 86, 87, 88, 89, 90, 91, 92, 93, 94, 95, 96, 97 98, 99, or 100%) to any one of the nucleotide sequence of SEQ ID NOs: 66-92, 680-721; or encodes a polypeptide comprising at least 80% sequence identity to any one of the amino acid sequences of SEQ ID NOs: 93-105, 617-658, or 743-775.

In some embodiments, a mutation may comprise a deletion of at least 1 base pair to about 1000, 1500, 1750, 2000, 2500, 3000, 3500, 4000, 4500, 5000, or 5600 base pairs or more of an AOP2 gene (e.g., 1, 3, 6, 9, 15, 20, 30, 40, 50, 100, 150, 200, 300, 400, 500, 600, 700, 800, 900 base pairs to about 1000, 1500, 2000, 2500, 3000, 3500, 4000, 4500, 5000, or 5600 base pairs or any range or value therein, optionally wherein the deleted base pairs are consecutive base pairs). In some embodiments, the deletion in an AOP2 gene may result in an in-frame or out of frame mutation, optionally wherein the in-frame or out of frame mutation results in a premature stop codon. In some embodiments, the deletion may be a deletion of the full length of the AOP2 gene. In some embodiments, the deletion is in the 5' end of the AOP2 gene. In some embodiments, a deletion useful with this invention may result in the production of no AOP2 protein by the gene comprising the deletion or may result in a truncated AOP2 protein that is non-functional (e.g., a null mutation or null allele), optionally wherein the truncation of the protein comprises a truncation of at least about 50 to about 300 consecutive amino acid residues or more from the C-terminal end of the protein (e.g., the C-terminal amino acid residue of the polypeptide through to about 50 to about 300 consecutive amino acid residues) (e.g., about 50, 55, 60, 65, 70, 75, 80, 85, 90, 95, 100, 120, 140, 160, 180, 200, 220, 240, 260, 280, 300 or more consecutive amino acid residues, or any range or value therein).

In some embodiments, a non-natural mutation comprising a base substitution in an AOP2 gene may produce a premature stop codon, wherein the premature stop codon results in production of no AOP2 protein or a truncated AOP2 protein (e.g., a null mutation or null allele) by the mutated AOP2 gene, optionally wherein the truncated AOP2 protein is non-functional. In some embodiments, a truncated AOP2 polypeptide resulting from a base substitution in the AOP2 gene comprises a truncation of at least about 50 to about 300 consecutive amino acid residues or more from the C-terminal end of the protein (e.g., the C-terminal amino acid residue of the polypeptide through to about 50 to about 300 consecutive amino acid residues) (e.g., about 50, 55, 60, 65, 70, 75, 80, 85, 90, 95, 100, 120, 140, 160, 180, 200, 220, 240, 260, 280, 300 or more consecutive amino acid residues).

In some embodiments, at least one non-natural mutation in an AOP2 gene (e.g., a deletion of three or more consecution base pairs or a substitution of one or more base pairs) results in a deletion of at least one amino acid residue from the AOP2 polypeptide produced from the mutated myrosinase gene (e.g., 1, 2, 3, 4, 5, 6, 7, 8, 9, 10, 20, 30, 40, 50, 60, 70, 80, 90, 100, 110, 120, 130, 140, 150, 160, 170, 180, 190, 200, 220, 250, 300, 320, 350, 360, 370, 380, 390, 400, 410, 420, 425, 430, 431, 432, 433, 434, 435, 436, 437, 438, or 439 amino acids, or any range or value therein). In some embodiments, the deletion in the AOP2 gene results in a deletion of two or more consecutive amino acid residues from the AOP2 polypeptide.

In some embodiments, an endogenous gene encoding AOP2 comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 118-127 or 722-736; or encodes a polypeptide comprising at least 80% sequence identity to any one of the amino acid sequences of SEQ ID NOs: 128-132, 659-673 or 776-781.

In some embodiments, a mutation may comprise a deletion of at least 1 base pair to about 1000, 1500, 2000, or 2100 base pairs or more of a CYP79F1 gene (e.g., 1, 3, 6, 9, 15, 20, 30, 40, 50, 100, 150, 200, 300, 400, 500, 600, 700, 800, 900 base pairs to about 1000, 1200, 1400, 1600, 1800, 1900, 2000 or 2100 base pairs or more, or any range or value therein, optionally wherein the deleted base pairs are consecutive base pairs). In some embodiments, the deletion in a CYP79F1 gene may result in an in-frame or out of frame mutation, optionally wherein the in-frame or out of frame mutation results in a premature stop codon. In some embodiments, the deletion may be a deletion of the full length of the CYP79F1 gene. In some embodiments, the deletion is in the 5' end of the CYP79F1 gene. In some embodiments, a deletion useful with this invention may result in the production of no CYP79F1 protein by the gene comprising the deletion or may result in a truncated CYP79F1 protein that is non-functional (e.g., a null mutation or null allele), optionally wherein the truncation of the protein comprises a truncation of at least about 50 to about 350 consecutive amino acid residues or more from the C-terminal end of the protein (e.g., the C-terminal amino acid residue of the polypeptide through to about 50 to about 300 consecutive amino acid residues) (e.g., about 50, 55, 60, 65, 70, 75, 80, 85, 90, 95, 100, 120, 140, 160, 180, 200, 220, 240, 260, 280, 300, 320, 340, or 350 or more consecutive amino acid residues).

In some embodiments, a non-natural mutation comprising a base substitution in a CYP79F1 gene may produce a premature stop codon, wherein the premature stop codon results in production of no CYP79F1 protein or a truncated CYP79F1 protein (e.g., a null mutation or null allele) by the mutated CYP79F1 gene, optionally wherein the truncated CYP79F1 protein is non-functional. In some embodiments, a truncated CYP79F1 polypeptide resulting from a base substitution in the CYP79F1 gene comprises a truncation of at least about 50 to about 350 consecutive amino acid residues or more from the C-terminal end of the protein (e.g., the C-terminal amino acid residue of the polypeptide through to about 50 to about 300 consecutive amino acid residues) (e.g., about 50, 55, 60, 65, 70, 75, 80, 85, 90, 95, 100, 120, 140, 160, 180, 200, 220, 240, 260, 280, 300, 320, 340, 350 or more consecutive amino acid residues).

In some embodiments, at least one non-natural mutation in an CYP79F1 gene (e.g., a deletion of three or more consecution base pairs or a substitution of one or more base pairs) results in a deletion of at least one amino acid residue from the CYP79F1 polypeptide produced from the mutated CYP79F1 gene (e.g., 1, 2, 3, 4, 5, 6, 7, 8, 9, 10, 20, 30, 40, 50, 60, 70, 80, 90, 100, 110, 120, 130, 140, 150, 160, 170, 180, 190, 200, 220, 250, 300, 320, 350, 360, 370, 380, 390, 400, 410, 420, 430, 440, 450, 460, 470, 480, 490, 500, 510, 520, 530, 531, 532, 534, 535, 536, 537, 538, 539, 540, or 541 amino acids, or any range or value therein). In some embodiments, the deletion in the CYP79F1 gene results in a deletion of two or more consecutive amino acid residues from the CYP79F1 polypeptide.

In some embodiments, a plant may comprise one or more (e.g., 1, 2, 3, 4, 5, or more), or two or more endogenous AOP2 genes (e.g., 2, 3, 4, 5, or more). In some embodiments, a plant or part thereof of this invention comprising one or more endogenous AOP2 genes may comprise a non-natural mutation in at least one endogenous AOP2 gene, wherein the mutation results in the production of a reduced amount of AOP2 or no AOP2 and a plant or part thereof having reduced pungency and/or bitterness. In some embodiments, a plant or part thereof of this invention comprising one or more endogenous AOP2 genes may comprise a non-natural mutation one endogenous AOP2 gene, wherein the mutation results in the production of a reduced amount of AOP1 or no AOP2 and a plant or part thereof having reduced pungency and/or bitterness. In some embodiments, a plant or part thereof of this invention may comprise a non-natural mutation in two AOP2 genes, wherein the mutation in the two genes results in the production of a reduced amount of AOP2 or no AOP2, and a plant or part thereof having reduced pungency and/or bitterness. In some embodiments, a plant or part thereof of this invention may comprise a non-natural mutation in three endogenous AOP2 genes, wherein the mutation in the three genes results in the production of a reduced amount of AOP2 or no AOP2, and a plant or part thereof having reduced pungency and/or bitterness. In some embodiments, a plant or part thereof of this invention may comprise a non-natural mutation in four endogenous AOP2 genes, wherein the mutation in the four genes results in the production of a reduced amount of AOP2 or no AOP2, and a plant or part thereof having reduced pungency and/or bitterness. In some embodiments, a plant or part thereof of this invention may comprise a non-natural mutation in five endogenous AOP2 genes, wherein the mutation in the five genes results in the production of a reduced amount of AOP2 or no AOP2, and a plant or part thereof having reduced pungency and/or bitterness. A reduction in pungency and/or bitterness is as compared to a control plant that does not comprise the same mutation and is grown under the same environmental conditions.

In some embodiments, an endogenous gene encoding CYP79F1 comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 113,114 or 737-742; or encodes a polypeptide comprising at least 80% sequence identity to any one of the amino acid sequences of SEQ ID NOs: 115, 674-679, or 782-786.

In some embodiments, a mustard plant cell comprising a base editing system is provided, the base editing system comprising: (a) a CRISPR-associated effector protein; (b) a cytidine deaminase or adenosine deaminase; and (c) a guide nucleic acid (gRNA) having a spacer sequence with complementarity to an endogenous target gene encoding a CYP79F1, an endogenous target gene encoding an AOP2, and/or an endogenous target gene encoding an myrosinase. In some embodiments, the gRNA of the base editing system comprises a spacer sequence having at least 80% identity to the nucleotide sequence of SEQ ID NO:116 or SEQ ID NO: 117, wherein the spacers are complementary (fully or substantially (e.g., at least 70%) complementary) to a CYP79F1 gene. In some embodiments, the gRNA of the base editing system comprises a spacer sequence having at least 80% identity to any one of the nucleotide sequences of SEQ ID NOS: 133-140, wherein the spacers are complementary (fully or substantially (e.g., at least 70%) complementary) to an AOP2 gene. In some embodiments, the gRNA of the base editing system comprises a spacer sequence having at least 80% identity to any one of the nucleotide sequences of SEQ ID NOs: 106-112, wherein the spacers are complementary (fully or substantially (e.g., at least 70%) complementary) to a myrosinase gene. FIGS. 1-5 illustrate alignments of spacer sequences from guide nucleic acids with myrosinase gene sequences, AOP2 gene sequences and CYP79F1 gene sequences.

In some embodiments, the nucleic acid binding domain of an editing system useful with this invention is from a polynucleotide-guided endonuclease, a CRISPR-Cas endonuclease (e.g., CRISPR-Cas effector protein), a zinc finger nuclease, a transcription activator-like effector nuclease (TALEN) and/or an Argonaute protein.

Further provided is a method of producing/breeding a transgene-free base-edited mustard plant, comprising: (a) crossing the plant of the present invention with a transgene free mustard plant, thereby introducing the at least one mutation, the mutation, or the modification into the mustard plant that is transgene-free; and (b) selecting a progeny plant that comprises the at least one single nucleotide substitution but is transgene-free, thereby producing a transgene free base-edited mustard plant.

In some embodiments, a transgene-free plant is a plant produced by the methods described herein and comprises a non-natural mutation in one or more myrosinase genes, one or more AOP2 genes and/or one or more CYP79F1 genes. In some embodiments, the invention provides a method of producing a transgene free plant having reduced pungency and/or bitterness, the method comprising crossing a first plant comprising a non-natural mutation in a myrosinase gene as described herein with a second plant comprising a non-natural mutation in an AOP2 gene and/or a CYP79F1 gene as described herein, selecting progeny comprising the non-natural mutation in the myrosinase gene and the non-natural mutation in the AOP2 gene and/or the CYP79F1 gene, thereby producing a transgene free plant having reduced pungency and/or bitterness. In some embodiments, the invention provides a method of producing a transgene free plant having reduced pungency and/or bitterness, the method comprising crossing a first plant comprising a non-natural mutation in an AOP2 gene as described herein with a second plant comprising a non-natural mutation in a myrosinase gene and/or a CYP79F1 gene as described herein, selecting progeny comprising the non-natural mutation in the AOP2 gene and the non-natural mutation in the myrosinase gene and/or the CYP79F1 gene, thereby producing a transgene free plant having reduced pungency and/or bitterness. In some embodiments, the invention provides a method of producing a transgene free plant having reduced pungency and/or bitterness, the method comprising crossing a first plant comprising a non-natural mutation in an CYP79F1 gene as described herein with a second plant comprising a non-natural mutation in a myrosinase gene and/or an AOP2 gene as described herein, selecting progeny comprising the non-natural mutation in the CYP79F1 gene and the non-natural mutation in the myrosinase gene and/or the AOP2 gene, thereby producing a transgene free plant having reduced pungency and/or bitterness.

Also provided is a method of providing a plurality of mustard plants exhibiting reduced pungency or bitterness, the method comprising planting two or more plants of the present invention in a growing area (e.g., a field (e.g., a cultivated field, an agricultural field), a growth chamber, a greenhouse, a recreational area, a lawn, and/or a roadside and the like), thereby providing a plurality of mustard plants exhibiting reduced pungency or bitterness as compared to a plurality of control mustard plants not comprising the mutation and grown under the same conditions.

Another aspect of the invention is a method for editing a specific site in the genome of a mustard plant cell, the method comprising: cleaving, in a site specific manner, a target site within an endogenous myrosinase gene, an endogenous AOP2 gene and/or an endogenous CYP79F1 gene, thereby generating an edit in the endogenous myrosinase gene, the endogenous AOP2 gene and/or the endogenous CYP79F1 gene of the plant cell and producing a plant cell comprising an edit in an endogenous myrosinase gene, an endogenous AOP2 gene and/or an endogenous CYP79F1 gene. In some embodiments, the plant cell comprising an edit in an endogenous myrosinase gene, an endogenous AOP2 gene and/or an endogenous CYP79F1 gene is regenerated into a plant, wherein the plant exhibits reduced pungency and/or bitterness as compared to a plant regenerated from a plant cell not comprising said edit and grown under the same conditions. In some embodiments, the edit results in a non-natural mutation. A non-natural mutation in a myrosinase gene, an AOP2 gene, or a CYP79F1 gene of a mustard plant or part thereof (including, e.g., a plant cell) may be any type of mutation, including a base substitution, a deletion and/or an insertion. In some embodiments, a non-natural mutation is a point mutation. In some embodiments, a non-natural mutation may be a substitution of at least one base pair, a deletion of at least one base pair, or an insertion of at least one base pair. In some embodiments, a non-natural mutation may comprise a base substitution to an A, a T, a G, or a C. In some embodiments, a base substitution may produce a premature stop codon, thereby producing no protein or a truncated protein, optionally wherein the truncated protein is non-functional. In some embodiments, a deletion of a base may result in an in-frame or out of frame mutation, optionally wherein the in-frame or out of frame mutation results in a premature stop codon. In some embodiments, a mutation in a gene that results in a premature stop codon produces no polypeptide or a produces a non-functional polypeptide, optionally wherein the non-functional polypeptide is a truncated polypeptide. In some embodiments, a non-natural mutation may be a dominant-negative allele, semi-dominant allele, weak loss of function allele, null allele, a hypermorphic mutation or a hypomorphic mutation. In some embodiments, a mutation is a null allele. In some embodiments, a mutation may be a full knockout mutant CYP79F1 allele, a full knockout mutant AOP2 allele and/or a full knockout mutant myrosinase allele that results in the production of a nonfunctional CYP79F1 protein or no production of the CYP79F1, production of a nonfunctional AOP2 protein or no production of a AOP2 protein, and/or production of a nonfunctional myrosinase protein or no production of a myrosinase protein.

The present invention further provides a method for making a mustard plant, comprising: (a) contacting a population of mustard plant cells comprising a DNA sequence that encodes a wild type endogenous myrosinase, a wild type endogenous AOP2 and/or a wild type endogenous CYP79F1 with a nuclease linked to a nucleic acid binding domain (e.g., editing system) that binds to a target sequence in the wild type endogenous myrosinase, the wild type endogenous AOP2 or the wild type endogenous CYP79F1, wherein (b) selecting a mustard plant cell from said population in which at least one DNA sequence encoding the wild type endogenous myrosinase, the wild type endogenous AOP2 and/or the wild type endogenous CYP79F1 has been mutated, wherein the mutation comprises a deletion of at least one nucleotide in the at least one DNA sequence; and (c) growing the selected plant cell into a mustard plant.

Additionally provided is a method for producing a mustard plant or part thereof comprising at least one cell in which an endogenous myrosinase gene, an endogenous AOP2 gene and/or an endogenous CYP79F1 gene is mutated, the method comprising contacting a target site in the endogenous myrosinase gene, the endogenous AOP2 gene and/or the endogenous CYP79F1 gene in the mustard plant or plant part with a nuclease linked to a nucleic acid binding domain (e.g., editing system) that binds to the target site, thereby producing a mustard plant or part thereof comprising at least one cell having a mutation in the endogenous myrosinase gene, the endogenous AOP2 gene and/or the endogenous CYP79F1 gene.

Also provided is a method for producing a mustard plant having a phenotype of reduced pungency and/or reduced bitterness, the method comprising (a) contacting a mustard plant cell comprising a wild type endogenous myrosinase gene, a wild type endogenous AOP2 gene and/or a wild type endogenous CYP79F1 gene with a nuclease targeting the wild type endogenous myrosinase gene, the wild type endogenous AOP2 gene or the wild type endogenous CYP79F1 gene, wherein the nuclease is linked to a DNA binding domain that binds to a target site in the wild type endogenous wild type endogenous myrosinase gene, the wild type endogenous AOP2 gene or the wild type endogenous CYP79F1 gene, and (b) growing the plant cell into a mustard plant, thereby producing a mustard plant having a phenotype of reduced pungency and/or reduced bitterness. A reduction in pungency is as compared to a control plant that does not comprise the same mutation and is grown under the same environmental conditions.

Additionally provided is a method for reducing pungency and/or bitterness in flavor or aroma in a mustard plant or part thereof, comprising (a) contacting a mustard plant cell comprising a wild type endogenous myrosinase gene, a wild type endogenous AOP2 gene and/or a wild type endogenous CYP79F1 gene with a nuclease targeting the wild type endogenous myrosinase gene, the wild type endogenous AOP2 gene or the wild type endogenous CYP79F1 gene, wherein the nuclease is linked to a DNA binding domain that binds to a target site in the wild type endogenous myrosinase gene, the wild type endogenous AOP2 gene or the wild type endogenous CYP79F1 gene to produce a plant cell comprising a mutation in the wild type endogenous myrosinase gene, the wild type endogenous AOP2 gene or the wild type endogenous CYP79F1 gene; and (b) growing the plant cell into a plant comprising the mutation in the wild type endogenous myrosinase gene, the wild type endogenous AOP2 gene and/or the wild type endogenous CYP79F1 gene, thereby reducing pungency and/or bitterness in flavor or aroma in a mustard plant or part thereof.

The present invention further provides a method for producing a mustard plant or part thereof comprising at least one cell having a mutated endogenous myrosinase gene, a mutated endogenous AOP2 gene and/or a mutated endogenous CYP79F1 gene, the method comprising contacting a target site in an endogenous myrosinase gene, an endogenous AOP2 gene and/or an endogenous CYP79F1 gene in the mustard plant or plant part with a nuclease comprising a cleavage domain and a DNA-binding domain, wherein the DNA binding domain binds to a target site in the endogenous myrosinase gene, the endogenous AOP2 gene and/or the endogenous CYP79F1 gene, thereby producing the plant or part thereof comprising at least one cell having a mutated endogenous myrosinase gene, a mutated endogenous AOP2 gene and/or a mutated endogenous CYP79F1 gene.

A method of producing a mustard plant or part thereof comprising a mutated endogenous myrosinase gene, a mutated endogenous AOP2 gene and/or a mutated endogenous CYP79F1 gene and having a phenotype of reduced pungency and/or bitterness is provided, the method comprising contacting a target site in an endogenous myrosinase gene, an endogenous AOP2 gene and/or an endogenous CYP79F1 gene with a nuclease comprising a cleavage domain and a DNA-binding domain (e.g., editing system) comprising a nucleic acid binding domain that binds to the target site in the endogenous myrosinase gene, the endogenous AOP2 gene and/or the endogenous CYP79F1 gene, thereby producing a mustard plant or part thereof comprising a mutated endogenous myrosinase gene, a mutated endogenous AOP2 gene and/or a mutated endogenous CYP79F1 gene and having reduced pungency and/or bitterness as compared to a control mustard plant (or part thereof) grown under the same conditions and does not comprise the mutation.

In some embodiments, an endogenous (e.g., wild type) myrosinase gene comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 66-92 or 680-721; or encodes a polypeptide comprising at least 80% sequence identity to any one of the amino acid sequences of SEQ ID NOs: 93-105, 617-658 or 743-775. In some embodiments, an endogenous (e.g., wild type) AOP2 gene comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 118-127 or 722-736; or encodes a polypeptide comprising at least 80% sequence identity to any one of the amino acid sequences of SEQ ID NOs: 128-132, 659-673 or 776-781. In some embodiments, an endogenous (e.g., wild type) CYP79F1 gene comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 113,114 or 737-742; or encodes a polypeptide comprising at least 80% sequence identity to any one of the amino acid sequences of SEQ ID NOs: 115, 674-679, or 782-786.

In some embodiments, a nuclease targeting the wild type endogenous myrosinase gene, a nuclease comprising a cleavage domain and a DNA-binding domain, a nuclease linked to a nucleic acid binding domain (e.g., editing system) that binds to the target site and/or a nuclease linked to a nucleic acid binding domain (e.g., editing system) that binds to a target sequence cleaves an endogenous myrosinase gene, an endogenous AOP2 gene and/or an endogenous CYP79F1 gene, thereby introducing a mutation into the endogenous myrosinase gene, the endogenous AOP2 gene and/or the endogenous CYP79F1 gene. In some embodiments, the nuclease is a zinc finger nuclease, a transcription activator-like effector nucleases (TALEN), an endonuclease (e.g. Fok1) or a CRISPR-Cas effector protein. In some embodiments, a DNA binding domain is a zinc finger, a transcription activator-like DNA binding domain (TAL), an argonaute or a CRISPR-Cas effector DNA binding domain.

In some embodiments, the mutation that is introduced may be a non-natural mutation, optionally wherein the non-natural mutation is a dominant-negative allele, semi-dominant allele, weak loss of function allele, null allele, a hypermorphic mutation or a hypomorphic mutation. In some embodiments, the mutation that is introduced results in a null allele. In some embodiments, the mutation is a base substitution, a base insertion or a base deletion, optionally wherein a base deletion may be an in-frame deletion or an out-of-frame deletion. In some embodiments, a non-natural mutation results in a premature stop codon. In some embodiments, a non-natural mutation is a full knockout mutant CYP79F1 allele, a full knockout mutant AOP2 allele and/or a full knockout mutant myrosinase allele, optionally wherein the full knockout mutant CYP79F1 allele results in the production of a nonfunctional CYP79F1 protein or no production of a CYP79F1 protein, the full knockout mutant AOP2 allele results in the production of a nonfunctional AOP2 protein or no production of a AOP2 protein, and the full knockout mutant myrosinase allele results in the production of a nonfunctional myrosinase protein or no production of a myrosinase protein. In some embodiments, a mutation of an endogenous myrosinase gene, an endogenous AOP2 gene or an endogenous CYP79F1 gene results in a truncated CYP79F1 protein, a truncated AOP2 protein, or a truncated myrosinase protein, respectively. In some embodiments, a non-natural mutation as described herein produces a plant (or part thereof) having the phenotype of reduced pungency and/or reduced bitterness in flavor and/or aroma as compared to a control plant (e.g., does not comprise said non-natural mutation and is grown under the same environmental conditions as the plant comprising said non-natural mutation.

In some embodiments, a mustard plant of this invention exhibits reduced pungency. In some embodiments, a mustard plant of the invention exhibits reduced bitterness. In some embodiments, a mustard plant of the invention exhibits reduced pungency and reduced bitterness. In some embodiments, a mustard plant of the invention comprises a mutation in at least one myrosinase gene and exhibits reduced bitterness. In some embodiments, a mustard plant of the invention comprises a mutation in at least one AOP2 gene and exhibits reduced pungency and reduced bitterness. In some embodiments, a mustard plant of the invention comprises a mutation in at least one CYP79F1 gene and exhibits reduced pungency and reduced bitterness. A reduction in pungency and/or bitterness is as compared to a control plant that does not comprise the same mutation and is grown under the same environmental conditions as the mustard plant comprising the mutation.

A mustard plant or part thereof (e.g., a plant in the Brassicaceae family, i.e., Cruciferae family or mustard family) useful with the invention includes any mustard plant comprising glucosinolates (e.g., a plant that produces glucosinolates or that breaks down (metabolizes) glucosinolates; e.g., a plant comprising at least one myrosinase gene or a plant with a at least one AOP2 gene and/or at least one CYP79F1 gene). In some embodiments, the mustard plant or part thereof includes, but is not limited to, a kale plant or part thereof, a collard plant or part thereof, a spinach plant or part thereof, a cabbage plant or part thereof, a beet plant or part thereof, a watercress plant or part thereof, a lettuce plant or part thereof (e.g. romaine), a swiss chard plant or part thereof, an arugula plant or part thereof, an endive plant or part thereof, a bok choy plant or part thereof, a rutabaga plant or part thereof, a turnip plant or part thereof, a mustard plant or part thereof, a cabbage plant or part thereof, a broccoli plant or part thereof, a cauliflower plant or part thereof, a Brussels sprout plant or part thereof, a radish plant or part thereof, or a kohlrabi plant or part thereof. In some embodiments, the mustard plant or part thereof includes, but is not limited to, *Brassica oleracea* (e.g., *B. oleracea* var. *oleracea*, *B. oleracea* var. *capitata*, *B. oleracea* var. *botrytis*, *B. oleracea* var. *gemmifera*, *B. oleracea* var. *sabauda*, *B. oleracea* var. *gongyiodes*, *B. oleracea* var. *italic*, *B. oleracea* var. *sabellica*, *B. oleracea* var. *acephala*), *Brassica juncea*, *Brassica rapa* (*B. rapa* subsp. *pekinensis*, *B. rapa* subsp. *Chinensis*, *B. rapa* subsp. *rapa*), *Brassica napas*, *Brassica carinata*, *Brassica campestris*, *Brassica nigra* or *Raphanus raphanistrum* (e.g., *Raphanus raphanistrum* subsp. *Sativus*).

In some embodiments, a plant (e.g., mustard plant) may be regenerated from any plant part of this invention, including a plant cell, comprising a mutation in an endogenous gene encoding a cytochrome P450 mono-oxygenase (i.e., CYP79F1, homomethionine N-monooxygenase; EC 1.14.14.42), an endogenous gene encoding a 2-oxo acid-dependent dioxygenase (i.e., AOP2, 2-oxoglutarate-dependent dioxygenase; EC 1.14.11.M8) and/or an endogenous gene encoding a myrosinase (i.e., glucosinolase, thioglucosidase (e.g., β-thioglucosidase), thioglucoside glucohydrolase; EC 3.2.1.147 (EC 3.2.3.1 transferred to 3.2.1.147)). In some embodiments, the regenerated mustard plant exhibits reduced pungency. In some embodiments, the regenerated plant exhibits reduced bitterness. In some embodiments, the regenerated mustard plant exhibits reduced pungency and reduced bitterness. In some embodiments, the regenerated mustard plant comprises a mutation in at least one myrosinase gene and exhibits reduced bitterness. In some embodiments, the regenerated mustard plant comprises a mutation in at least one AOP2 gene and exhibits reduced pungency and reduced bitterness. In some embodiments, the regenerated mustard plant comprises a mutation in at least one CYP79F1 gene and exhibits reduced pungency and reduced bitterness. A reduction in pungency is as compared to a control plant that does not comprise the same mutation and is grown under the same environmental conditions as the plant comprising said mutation.

The present invention further provides a guide nucleic acid (e.g., gRNA, gDNA, crRNA, crDNA) that binds to a target site in an endogenous myrosinase gene, in an endogenous AOP2 gene or in an endogenous CYP79F1 gene. In some embodiments, the guide nucleic acid comprises a spacer sequence having at least 80% identity to the nucleotide sequence of SEQ ID NO: 116 or SEQ ID NO:117, wherein the spacers are complementary (fully or substantially (e.g., at least 70%) complementary) to a CYP79F1 gene. In some embodiments, the gRNA of the base editing system comprises a spacer sequence having at least 80% identity to any one of the nucleotide sequences of SEQ ID NOS: 133-140, wherein the spacers are complementary (fully or substantially (e.g., at least 70%) complementary) to an AOP2 gene. In some embodiments, the gRNA of the base editing system comprises a spacer sequence having at least 80% identity to any one of the nucleotide sequences of SEQ ID NOs: 106-112, wherein the spacers are complementary (fully or substantially (e.g., at least 70%) complementary) to a myrosinase gene. In some embodiments, the guide nucleic acid comprises a spacer sequence having the nucleotide sequence of SEQ ID NO:116 or SEQ ID NO:117, any one of SEQ ID NOs: 106-112, or any one of SEQ ID NOs: 133-140.

In some embodiments, the endogenous myrosinase gene comprising the target site to which the guide nucleic acid binds comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 66-92 or 680-721; or encodes a polypeptide comprising at least 80% sequence identity to any one of the amino acid sequences of SEQ ID NOs: 93-105, 617-658 or 743-775. In some embodiments, the endogenous AOP2 gene comprising the target site to which the guide nucleic acid binds comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 118-127 or 722-736; or encodes a polypeptide comprising at least 80% sequence identity to any one of the amino acid sequences of SEQ ID NOs: 128-132, 659-673 or 776-781. In some embodiments, the endogenous CYP79F1 gene comprising the target site to which the guide nucleic acid binds comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 113,114 or 737-742, or encodes a polypeptide comprising at least 80% sequence identity to any one of the amino acid sequences of SEQ ID NOs: 115, 674-679, or 782-786.

The present invention further provides a system comprising the guide nucleic acid of the invention and a CRISPR-Cas effector protein that associates with the guide nucleic acid. In some embodiments the system further comprises a tracr nucleic acid that associates with the guide nucleic acid and a CRISPR-Cas effector protein, optionally wherein the tracr nucleic acid and the guide nucleic acid are covalently linked.

In some embodiments, the present invention provides a gene editing system comprising a CRISPR-Cas effector protein in association with a guide nucleic acid, wherein the guide nucleic acid comprises a spacer sequence that binds to an endogenous myrosinase gene, in an endogenous AOP2 gene or in an endogenous CYP79F1 gene as described herein. In some embodiments, a gene editing system of the invention may further comprising a tracr nucleic acid that associates with the guide nucleic acid and a CRISPR-Cas effector protein, optionally wherein the tracr nucleic acid and the guide nucleic acid are covalently linked.

In some embodiments, the endogenous myrosinase gene to which the spacer sequence of a gene editing system of the invention binds comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 66-92 or 680-721; or encodes a polypeptide comprising at least 80% sequence identity to any one of the amino acid sequences of SEQ ID NOs: 93-105, 617-658 or 743-775. In some embodiments, the endogenous AOP2 gene to which the spacer sequence of a gene editing system of the invention binds comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 118-127 or 722-736; or encodes a polypeptide comprising at least 80% sequence identity to any one of the amino acid sequences of SEQ ID NOs: 128-132, 659-673 or 776-781. In some embodiments, the endogenous CYP79F1 gene to which the spacer sequence of a gene editing system of the invention binds comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 113,114 or 737-742; or encodes a polypeptide comprising at least 80% sequence identity to any one of the amino acid sequences of SEQ ID NO:115, 674-679, or 782-786.

In some embodiments the guide nucleic acid of a gene editing system of the invention comprises a spacer sequence having at least 80% identity to the nucleotide sequence of SEQ ID NO: 116 or SEQ ID NO:117, wherein the spacers are complementary (fully or substantially (e.g., at least 70%) complementary) to a CYP79F1 gene. In some embodiments, the gRNA of the base editing system comprises a spacer sequence having at least 80% identity to any one of the nucleotide sequences of SEQ ID NOs: 133-140, wherein the spacers are complementary (fully or substantially (e.g., at least 70%) complementary) to an AOP2 gene. In some embodiments, the gRNA of the base editing system comprises a spacer sequence having at least 80% identity to any one of the nucleotide sequences of SEQ ID NOs: 106-112, wherein the spacers are complementary (fully or substantially (e.g., at least 70%) complementary) to a myrosinase gene. In some embodiments, the guide nucleic acid of a gene editing system of the invention comprises a spacer sequence having the nucleotide sequence of SEQ ID NO:116 or SEQ ID NO:117, any one of SEQ ID NOs: 106-112, or any one of SEQ ID NOs: 133-140.

The present invention further provides a complex comprising a CRISPR-Cas effector protein comprising a cleavage domain and a guide nucleic acid, wherein the guide nucleic acid binds to a target site in an endogenous myrosinase gene, in an endogenous AOP2 gene or in an endogenous CYP79F1 gene, wherein the cleavage domain cleaves a target strand in the endogenous myrosinase gene, in the endogenous AOP2 gene or in the endogenous CYP79F1 gene as described herein. In some embodiments, an endogenous myrosinase gene comprising a target site to which the guide nucleic acid of a complex of this invention binds comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOS: 66-92 or 680-721; or encodes a polypeptide comprising at least 80% sequence identity to any one of the amino acid sequences of SEQ ID NOs: 93-105, 617-658 or 743-775. In some embodiments, an endogenous AOP2 gene comprising a target site to which the guide nucleic acid of a complex of this invention binds comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 118-127 or 722-736; or encodes a polypeptide comprising at least 80% sequence identity to any one of the amino acid sequences of SEQ ID NOs: 128-132, 659-673 or 776-781. In some embodiments, an endogenous CYP79F1 gene comprising a target site to which the guide nucleic acid of a complex of this invention binds comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 113,114 or 737-742; or encodes a polypeptide comprising at least 80% sequence identity to any one of the amino acid sequences of SEQ ID NOs: 115, 674-679, or 782-786.

Further provided is an expression cassette comprising a (a) polynucleotide encoding CRISPR-Cas effector protein comprising a cleavage domain and (b) a guide nucleic acid that binds to a target site in an endogenous myrosinase gene, in an endogenous AOP2 gene or in an endogenous CYP79F1 gene, wherein the guide nucleic acid comprises a spacer sequence that is complementary to and binds to a sequence having at least 80% sequence identity to at least a portion of a sequence having at least 80% sequence identity to the nucleotide sequence of any one of SEQ ID NOs: 66-92, SEQ ID NO: 113, SEQ ID NO:114, SEQ ID NOS: 118-127 or SEQ ID NOs: 68-742, optionally wherein a portion is about 2 to about 22 consecutive nucleotides in length.

Additionally provided is a nucleic acid encoding a dominant-negative allele, semi-dominant allele, weak loss of function allele, null allele, a hypermorphic mutation or a hypomorphic mutation of a myrosinase gene, a CYP79F1 gene or an AOP2 gene. In some embodiments, the nucleic acid encodes a null allele. In some embodiments, the nucleic acid that encodes a null allele is a full knockout mutant CYP79F1 allele, a full knockout mutant AOP2 allele and/or a full knockout mutant myrosinase allele. In some embodiments, the full knockout mutant CYP79F1 allele results in the production of a nonfunctional CYP79F1 protein or no production of a CYP79F1 protein. In some embodiments, the full knockout mutant AOP2 allele results in the production of a nonfunctional AOP2 protein or no production of an AOP2 protein. In some embodiments, the full knockout mutant myrosinase allele results in the production of a nonfunctional myrosinase protein or no production of a myrosinase protein. In some embodiments, the present invention provides a mustard plant comprising the nucleic acid encoding a null allele of a myrosinase gene, a CYP79F1 gene or an AOP2 gene. In some embodiments, the mustard plant comprising a nucleic acid of this invention encoding the null allele exhibits reduced pungency. In some embodiments, the mustard plant comprising a nucleic acid of this invention encoding the null allele exhibits reduced bitterness. In some embodiments, the mustard plant comprising a nucleic acid of this invention encoding the null allele exhibits reduced pungency and reduced bitterness. In some embodiments, the mustard plant comprising a nucleic acid of this invention encoding at least one myrosinase null allele exhibits reduced bitterness. In some embodiments, the mustard plant comprising a nucleic acid of this invention encoding at least one AOP2 null allele exhibits reduced pungency and reduced bitterness. In some embodiments, the mustard plant comprising a nucleic acid of this invention encoding at least one CYP79F1 null allele and exhibits reduced pungency and reduced bitterness. A reduction in pungency and/or bitterness is as compared to a control plant that does not comprise the same mutation (e.g., the same null allele) and is grown under the same environmental conditions as the mustard plant comprising the null allele.

The present invention further provides a method of producing a mustard plant having at least one myrosinase gene and/or by at least one AOP2 gene and/or by a CYP79F1 gene with reduced expression (e.g., 5%-100% reduced), and/or reduced production (e.g., 5%-100% reduced) of at least one myrosinase, at least one AOP2 or a CYP79F1, the method comprising (a) contacting a population of mustard plant cells comprising a DNA sequence that encodes a wild type endogenous myrosinase, a wild type endogenous AOP2 and/or a wild type endogenous CYP79F1 with (i) a nuclease linked to a nucleic acid binding domain (e.g., editing system) that binds to a target sequence in the wild type endogenous myrosinase, the wild type endogenous AOP2 or the wild type endogenous CYP79F1, (ii) an RNAi that targets the wild type endogenous myrosinase, the wild type endogenous AOP2 or the wild type endogenous CYP79F1, or (iii) or an siRNA that targets the wild type endogenous myrosinase, the wild type endogenous AOP2 or the wild type endogenous, (b) selecting a mustard plant cell from said population having reduced expression of at least one myrosinase gene, of at least one AOP2 gene or of the CYP79F1 gene, and/or reduced production of the at least one myrosinase, the at least one AOP2 or the CYP79F1; and (c) growing the selected plant cell into a mustard plant. Also provided is a mustard plant produced by this method, optionally wherein the mustard plant comprises reduced pungency and/or bitterness as compared to a control plant.

The present invention further provides a mustard plant comprising an RNAi or a siRNA that is complementary to at least one myrosinase gene, at least one AOP2 gene and/or a CYP79F1 gene and reduced expression of the at least one myrosinase gene, the at least one AOP2 gene and/or the CYP79F1 gene.

A mustard plant or part thereof may include but is not limited to a kale plant or part thereof, a collard plant or part thereof, a spinach plant or part thereof, a cabbage plant or part thereof, a beet plant or part thereof, a watercress plant or part thereof, a lettuce plant or part thereof (e.g. romaine), a swiss chard plant or part thereof, an arugula plant or part thereof, an endive plant or part thereof, a bok choy plant or part thereof, a rutabaga plant or part thereof, a turnip plant or part thereof, a mustard plant or part thereof, a cabbage plant or part thereof, a broccoli plant or part thereof, a cauliflower plant or part thereof, a Brussels sprout plant or part thereof, a radish plant or part thereof, or a kohlrabi plant or part thereof. In some embodiments, the mustard plant or part thereof includes, but is not limited to, *Brassica oleracea* (e.g., *B. oleracea* var. *oleracea*, *B. oleracea* var. *capitata*, *B. oleracea* var. *botrytis*, *B. oleracea* var. *gemmifera*, *B. oleracea* var. *sabauda*, *B. oleracea* var. *gongyiodes*, *B. oleracea* var. *italic*, *B. oleracea* var. *sabellica*, *B. oleracea* var. *acephala*), *Brassica juncea*, *Brassica rapa* (*B. rapa* subsp. *pekinensis*, *B. rapa* subsp. *Chinensis*, *B. rapa* subsp. *rapa*), *Brassica napas*, *Brassica carinata*, *Brassica campestris*, *Brassica nigra* or *Raphanus raphanistrum* (e.g., *Raphanus raphanistrum* subsp. *Sativus*).

In some embodiments, the wild type endogenous myrosinase gene which is targeted by the siRNA or the RNAi or which comprises the target site to which the nucleic acid binding domain binds comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 66-92 or 680-721; or encodes a polypeptide comprising at least 80% sequence identity to any one of the amino acid sequences of SEQ ID NOs: 93-105, 617-658 or 743-775. In some embodiments, the wild type endogenous AOP2 gene which is targeted by the siRNA or the RNAi or which comprises the target site to which the nucleic acid binding domain binds comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: SEQ ID NOs: 118-127 or 722-736; or encodes a polypeptide comprising at least 80% sequence identity to any one of the amino acid sequences of SEQ ID NOs: 128-132, 659-673 or 776-781. In some embodiments, the wild type endogenous CYP79F1 gene which is targeted by the siRNA or the RNAi or which comprises the target site to which the nucleic acid binding domain binds comprises a nucleotide sequence having at least 80% sequence identity (e.g., 80, 81, 82, 83, 84, 85, 86, 87, 88, 89, 90, 91, 92, 93, 94, 95, 96, 97 98, 99, or 100%) to any one of the nucleotide sequence of SEQ ID NOs: 113,114 or 737-742; or encodes a polypeptide comprising at least 80% sequence identity to any one of the amino acid sequences of SEQ ID NOs: 115, 674-679, or 782-786.

An editing system useful with this invention can be any site-specific (sequence-specific) genome editing system now known or later developed, which system can introduce mutations in target specific manner. For example, an editing system (e.g., site- or sequence-specific editing system) can include, but is not limited to, a CRISPR-Cas editing system, a meganuclease editing system, a zinc finger nuclease (ZFN) editing system, a transcription activator-like effector nuclease (TALEN) editing system, a base editing system and/or a prime editing system, each of which can comprise one or more polypeptides and/or one or more polynucleotides that when expressed as a system in a cell can modify (mutate) a target nucleic acid in a sequence specific manner. In some embodiments, an editing system (e.g., site- or sequence-specific editing system) can comprise one or more polynucleotides and/or one or more polypeptides, including but not limited to a nucleic acid binding domain (DNA binding domain), a nuclease, and/or other polypeptide, and/or a polynucleotide.

In some embodiments, an editing system can comprise one or more sequence-specific nucleic acid binding domains (DNA binding domains) that can be from, for example, a polynucleotide-guided endonuclease, a CRISPR-Cas endonuclease (e.g., CRISPR-Cas effector protein), a zinc finger nuclease, a transcription activator-like effector nuclease (TALEN) and/or an Argonaute protein. In some embodiments, an editing system can comprise one or more cleavage domains (e.g., nucleases) including, but not limited to, an endonuclease (e.g., Fok1), a polynucleotide-guided endonuclease, a CRISPR-Cas endonuclease (e.g., CRISPR-Cas effector protein), a zinc finger nuclease, and/or a transcription activator-like effector nuclease (TALEN). In some embodiments, an editing system can comprise one or more polypeptides that include, but are not limited to, a deaminase (e.g., a cytosine deaminase, an adenine deaminase), a reverse transcriptase, a Dna2 polypeptide, and/or a 5' flap endonuclease (FEN). In some embodiments, an editing system can comprise one or more polynucleotides, including, but is not limited to, a CRISPR array (CRISPR guide) nucleic acid, extended guide nucleic acid, and/or a reverse transcriptase template.

In some embodiments, a method of modifying or editing an endogenous gene may comprise contacting a target nucleic acid (e.g., a nucleic acid encoding an endogenous myrosinase gene, AOP2 gene, or CYP79F1 gene) with a base-editing fusion protein (e.g., a sequence specific DNA binding protein (e.g., a CRISPR-Cas effector protein or domain) fused to a deaminase domain (e.g., an adenine deaminase and/or a cytosine deaminase) and a guide nucleic acid, wherein the guide nucleic acid is capable of guiding/targeting the base editing fusion protein to the target nucleic acid, thereby editing a locus within the target nucleic acid. In some embodiments, a base editing fusion protein and guide nucleic acid may be comprised in one or more expression cassettes. In some embodiments, the target nucleic acid may be contacted with a base editing fusion protein and an expression cassette comprising a guide nucleic acid. In some embodiments, the sequence-specific DNA binding fusion proteins and guides may be provided as ribonucleoproteins (RNPs). In some embodiments, a cell may be contacted with more than one base-editing fusion protein and/or one or more guide nucleic acids that may target one or more target nucleic acids in the cell.

In some embodiments, a method of modifying or editing an endogenous myrosinase gene, AOP2 gene, and/or CYP79F1 gene may comprise contacting a target nucleic acid (e.g., a nucleic acid encoding an endogenous myrosinase gene, AOP2 gene, and/or CYP79F1 gene) with a sequence-specific DNA binding fusion protein (e.g., a sequence-specific DNA binding protein (e.g., a CRISPR-Cas effector protein or domain) fused to a peptide tag, a deaminase fusion protein comprising a deaminase domain (e.g., an adenine deaminase and/or a cytosine deaminase) fused to an affinity polypeptide that is capable of binding to the peptide tag, and a guide nucleic acid, wherein the guide nucleic acid is capable of guiding/targeting the sequence-specific DNA binding fusion protein to the target nucleic acid and the sequence-specific DNA binding fusion protein is capable of recruiting the deaminase fusion protein to the target nucleic acid via the peptide tag-affinity polypeptide interaction, thereby editing a locus within the target nucleic acid. In some embodiments, the sequence-specific DNA binding fusion protein may be fused to the affinity polypeptide that binds the peptide tag and the deaminase may be fuse to the peptide tag, thereby recruiting the deaminase to the sequence-specific DNA binding fusion protein and to the target nucleic acid. In some embodiments, the sequence-specific binding fusion protein, deaminase fusion protein, and guide nucleic acid may be comprised in one or more expression cassettes. In some embodiments, the target nucleic acid may be contacted with a sequence-specific binding fusion protein, deaminase fusion protein, and an expression cassette comprising a guide nucleic acid. In some embodiments, the sequence-specific DNA binding fusion proteins, deaminase fusion proteins and guides may be provided as ribonucleoproteins (RNPs).

In some embodiments, methods such as prime editing may be used to generate a mutation in an endogenous myrosinase gene, AOP2 gene, and/or CYP79F1 gene. In prime editing, RNA-dependent DNA polymerase (reverse transcriptase, RT) and reverse transcriptase templates (RT template) are used in combination with sequence specific DNA binding domains that confer the ability to recognize and bind the target in a sequence-specific manner, and which can also cause a nick of the PAM-containing strand within the target. The DNA binding domain may be a CRISPR-Cas effector protein and in this case, the CRISPR array or guide RNA may be an extended guide that comprises an extended portion comprising a primer binding site (PSB) and the edit to be incorporated into the genome (the template). Similar to base editing, prime editing can take advantageous of the various methods of recruiting proteins for use in the editing to the target site, such methods including both non-covalent and covalent interactions between the proteins and nucleic acids used in the selected process of genome editing.

As used herein, a "CRISPR-Cas effector protein" is a protein or polypeptide or domain thereof that cleaves or cuts a nucleic acid, binds a nucleic acid (e.g., a target nucleic acid and/or a guide nucleic acid), and/or that identifies, recognizes, or binds a guide nucleic acid as defined herein. In some embodiments, a CRISPR-Cas effector protein may be an enzyme (e.g., a nuclease, endonuclease, nickase, etc.) or portion thereof and/or may function as an enzyme. In some embodiments, a CRISPR-Cas effector protein refers to a CRISPR-Cas nuclease polypeptide or domain thereof that comprises nuclease activity or in which the nuclease activity has been reduced or eliminated, and/or comprises nickase activity or in which the nickase has been reduced or eliminated, and/or comprises single stranded DNA cleavage activity (ss DNAse activity) or in which the ss DNAse activity has been reduced or eliminated, and/or comprises self-processing RNAse activity or in which the self-processing RNAse activity has been reduced or eliminated. A CRISPR-Cas effector protein may bind to a target nucleic acid. Thus, a "CRISPR-associated effector" or "CRISPR-Cas effector protein" as used herein can be defined as any nuclease, nickase, or recombinase associated with the CRISPR (Clustered Regularly Interspaced Short Palindromic Repeats), having the capacity to introduce a single- or double-strand cleavage into a genomic target site, or having the capacity to introduce a targeted modification, including a point mutation, an insertion, or a deletion, into a genomic target site of interest. A CRISPR-Cas effector protein can act on its own, or in combination with other molecules as part of a molecular complex. The CRISPR-Cas effector protein can be a fusion molecule, or can be provided as individual molecules associating by or being associated by at least one of a covalent or noncovalent interaction with a guide (gRNA) and/or target site so that the components of the CRISPR-associated complex are brought into close physical proximity.

In some embodiments, a sequence-specific DNA binding domain may be a CRISPR-Cas effector protein. In some embodiments, a CRISPR-Cas effector protein may be from a Type I CRISPR-Cas system, a Type II CRISPR-Cas system, a Type III CRISPR-Cas system, a Type IV CRISPR-Cas system, Type V CRISPR-Cas system, or a Type VI CRISPR-Cas system. In some embodiments, a CRISPR-Cas effector protein of the invention may be from a Type II CRISPR-Cas system or a Type V CRISPR-Cas system. In some embodiments, a CRISPR-Cas effector protein may be Type II CRISPR-Cas effector protein, for example, a Cas9 effector protein. In some embodiments, a CRISPR-Cas effector protein may be Type V CRISPR-Cas effector protein, for example, a Cas12 effector protein.

In some embodiments, a CRISPR-Cas effector protein or domain thereof can include but is not limited to a Cas protein derived from *S. pyogenes, S. aureus, N. meningitidis,* S. thermophiles, Acidovorax *avenae, Actinobacillus pleuropneumoniae, Actinobacillus succinogenes, Actinobacillus suis, Actinomyces* sp., Cycliphilusdenitrificans, Aminomonas *paucivorans, Bacillus cereus, Bacillus smithii, Bacillus thuringiensis, Bacteroides* sp., Blastopirellula marina, *Bradyrhizobium* sp., *Brevibacillus* laterospoxus, *Campylobacter coli, Campylobacter jejuni, Campylobacter lari, Candidatus puniceispirillum, Clostridium cellulolyticum, Clostridium perfringens, Corynebacterium accolens, Corynebacterium diphtheria, Corynebacterium matruchotii, Dinoroseobacter shibae, Eubacterium* dolichum, Gammaproteobacterium, *Gluconacetobacter diazotrophicus, Haemophilus parainfluenzae, Haemophilus sputomm, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis* sp., *Methylosinus trichosporium, Mobiluncus mulieris, Neisseria bacilliformis, Neisseria cinerea, Neisseria flavescens, Neisseria lactamica, Neisseria meningitidis, Neisseria* sp., *Neisseria* wadsworthii, *Nitrosomonas* sp., Parvibaculum lavamentivorans, *Pasteurella multocida, Phascolarctobacterium succinatutens, Ralstonia syzygii, Rhodopseudomonas palustris,* Rhodovulum sp., Simonsiella muelleri, *Sphingomonas* sp., Sporolactobacillus vineae, *Staphylococcus aureus, Staphylococcus lugdunensis, Streptococcus* sp., Subdoligranulum sp., Tistrella *mobilis, Treponema* sp., or Verminephrobacter eiseniae.

In some embodiments, the CRISPR-Cas effector protein can include a naturally-occurring Cas protein. In other embodiments, the Cas protein may be an engineered Cas protein. In some embodiments, a CRISPR-Cas effector protein may include, but is not limited to, a Cas9, C2c1, C2c3, Cas12a (also referred to as Cpf1), Cas12b, Cas12c, Cas12d, Cas12e, Cas13a, Cas13b, Cas13c, Cas13d, Casl, CasIB, Cas2, Cas3, Cas3', Cas3", Cas4, Cas5, Cas6, Cas7, Cas8, Cas9 (also known as Csn1 and Csx12), Cas10, Csy1, Csy2, Csy3, Csel, Cse2, Cscl, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csxl4, Csx10, Csx16, CsaX, Csx3, Csx1, Csx15, Csf1, Csf2, Csf3, Csf4 (dinG), and/or Csf5 nuclease, optionally wherein the CRISPR-Cas effector protein may be a Cas9, Cas12a (Cpf1), Cas12b, Cas12c (C2c3), Cas12d (CasY), Cas12e (CasX), Cas12g, Cas12h, Cas12i, C2c4, C2c5, C2c8, C2c9, C2c10, Cas14a, Cas14b, and/or Cas 14c effector protein.

In some embodiments, the CRISPR-Cas effector protein or domain thereof is an endoribonuclease such as a Cas13 protein. In some embodiments, the Cas13 protein is a Cas13a (Abudayyeh et al., *Nature* 550 (2017), 280-284), Cas13b (Cox et al., *Science* (2017) 358:6336, 1019-1027), Cas13c (Cox et al., *Science* (2017) 358:6336, 1019-1027), or Cas13d (Zhang et al., *Cell* 175 (2018), 212-223) protein.

In some embodiments, a CRISPR-Cas effector protein useful with the invention may comprise a mutation in its nuclease active site (e.g., RuvC, HNH, e.g., RuvC site of a Cas12a nuclease domain; e.g., RuvC site and/or HNH site of a Cas9 nuclease domain). A CRISPR-Cas effector protein having a mutation in its nuclease active site, and therefore, no longer comprising nuclease activity, is commonly referred to as "dead," e.g., dCas. In some embodiments, a CRISPR-Cas effector protein domain or polypeptide having a mutation in its nuclease active site may have impaired activity or reduced activity as compared to the same CRISPR-Cas effector protein without the mutation, e.g., a nickase, e.g., Cas9 nickase, Cas12a nickase.

In some embodiments, a Cas polypeptide comprises one or more of the following activities: (a) a nickase activity, i.e., the ability to cleave a single strand, e.g., the non-complementary strand or the complementary strand, of a nucleic acid molecule; (b) a double stranded nuclease activity, i.e., the ability to cleave both strands of a double stranded nucleic acid and create a double stranded break, which in an embodiment is the presence of two nickase activities; (c) an endonuclease activity; (d) an exonuclease activity; and/or (e) a helicase activity, i.e., the ability to unwind the helical structure of a double stranded nucleic acid. In other embodiments, the Cas protein may be dead or inactive (e.g. dCas).

In some embodiments, the Cas polypeptide is fused to a heterologous polypeptide/protein that has, for example, base deaminase activity.

A CRISPR Cas9 effector protein or CRISPR Cas9 effector domain useful with this invention may be any known or later identified Cas9 nuclease. In some embodiments, a CRISPR Cas9 polypeptide can be a Cas9 polypeptide from, for example, *Streptococcus* spp. (e.g., *S. pyogenes, S. thermophilus*), *Lactobacillus* spp., *Bifidobacterium* spp., *Kandleria* spp., *Leuconostoc* spp., Oenococcus spp., *Pediococcus* spp., Weissella spp., and/or Olsenella spp. Example Cas9 sequences include, but are not limited to, the amino acid sequences of SEQ ID NO: 53 and SEQ ID NO:54 or the nucleotide sequences of SEQ ID NOs: 55-65.

In some embodiments, the CRISPR-Cas effector protein may be a Cas9 polypeptide derived from *Streptococcus pyogenes* and recognizes the PAM sequence motif NGG, NAG, NGA (Mali et al, *Science* 2013; 339 (6121): 823-826). In some embodiments, the CRISPR-Cas effector protein may be a Cas9 polypeptide derived from *Streptococcus thermophiles* and recognizes the PAM sequence motif NGGNG and/or NNAGAAW (W=A or T) (See, e.g., Horvath et al, *Science,* 2010; 327 (5962): 167-170, and Deveau et al, *J Bacteriol* 2008; 190 (4): 1390-1400). In some embodiments, the CRISPR-Cas effector protein may be a Cas9 polypeptide derived from *Streptococcus mutans* and recognizes the PAM sequence motif NGG and/or NAAR (R=A or G) (See, e.g., Deveau et al, *J BACTERIOL* 2008; 190 (4): 1390-1400). In some embodiments, the CRISPR-Cas effector protein may be a Cas9 polypeptide derived from *Streptococcus aureus* and recognizes the PAM sequence motif NNGRR (R=A or G). In some embodiments, the CRISPR-Cas effector protein may be a Cas9 protein derived from *S. aureus,* which recognizes the PAM sequence motif N GRRT (R=A or G). In some embodiments, the CRISPR-Cas effector protein may be a Cas9 polypeptide derived from *S. aureus,* which recognizes the PAM sequence motif N GRRV (R=A or G). In some embodiments, the CRISPR-Cas effector protein may be a Cas9 polypeptide that is derived from *Neisseria meningitidis* and recognizes the PAM sequence motif N GATT or N GCTT (R=A or G, V=A, G or C) (See, e.g., Hou et ah, *PNAS* 2013, 1-6). In the aforementioned embodiments, N can be any nucleotide residue, e.g., any of A, G, C or T. In some embodiments, the CRISPR-Cas effector protein may be a Cas13a protein derived from Leptotrichia shahii, which recognizes a protospacer flanking sequence (PFS) (or RNA PAM (rPAM)) sequence motif of a single 3' A, U, or C, which may be located within the target nucleic acid.

In some embodiments, the CRISPR-Cas effector protein may be derived from Cas12a, which is a Type V Clustered Regularly Interspaced Short Palindromic Repeats (CRISPR)-Cas nuclease see, e.g., SEQ ID NOs1-20). Cas12a differs in several respects from the more well-known Type II CRISPR Cas9 nuclease. For example, Cas9 recognizes a G-rich protospacer-adjacent motif (PAM) that is 3' to its guide RNA (gRNA, sgRNA, crRNA, crDNA, CRISPR array) binding site (protospacer, target nucleic acid, target DNA) (3'-NGG), while Cas12a recognizes a T-rich PAM that is located 5' to the target nucleic acid (5'-TTN, 5'-TTTN. In fact, the orientations in which Cas9 and Cas12a bind their guide RNAs are very nearly reversed in relation to their N and C termini. Furthermore, Cas12a enzymes use a single guide RNA (gRNA, CRISPR array, crRNA) rather than the dual guide RNA (sgRNA (e.g., crRNA and tracrRNA)) found in natural Cas9 systems, and Cas12a processes its own gRNAs. Additionally, Cas12a nuclease activity produces staggered DNA double stranded breaks instead of blunt ends produced by Cas9 nuclease activity, and Cas12a relies on a single RuvC domain to cleave both DNA strands, whereas Cas9 utilizes an HNH domain and a RuvC domain for cleavage.

A CRISPR Cas12a effector protein/domain useful with this invention may be any known or later identified Cas12a polypeptide (previously known as Cpf1) (see, e.g., U.S. Pat. No. 9,790,490, which is incorporated by reference for its disclosures of Cpf1 (Cas12a) sequences). The term "Cas12a", "Cas12a polypeptide" or "Cas12a domain" refers to an RNA-guided nuclease comprising a Cas12a polypeptide, or a fragment thereof, which comprises the guide nucleic acid binding domain of Cas12a and/or an active, inactive, or partially active DNA cleavage domain of Cas12a. In some embodiments, a Cas12a useful with the invention may comprise a mutation in the nuclease active site (e.g., RuvC site of the Cas12a domain). A Cas12a domain or Cas12a polypeptide having a mutation in its nuclease active site, and therefore, no longer comprising nuclease activity, is commonly referred to as deadCas12a (e.g., dCas12a). In some embodiments, a Cas12a domain or Cas12a polypeptide having a mutation in its nuclease active site may have impaired activity, e.g., may have nickase activity.

In embodiments, a CRISPR-associated effector protein or domain thereof is codon-optimized for, for example a plant genome, e.g., a mustard plant genome, e.g., a *Brassica* spp.

In some embodiments, a CRISPR-associated effector is a nuclease, e.g., a CRISPR nuclease, including, but not limited to, Cas9 or Cpf1 (Cas12a) nucleases. Example Cas12a polypeptides useful with this invention include, but are not limited to SEQ ID NOs: 1-17. Example Cas9 polypeptides useful with this invention include, but are not limited to SEQ ID NO:53 and SEQ ID NO:54. Example Cas9 polynucleotides useful with this invention include, but are not limited to SEQ ID NOs: 55-65.

In some embodiments, a CRISPR-Cas effector protein is a Cas polypeptide or domain thereof. In some embodiments, the CRISPR-Cas effector protein is a Cas polypeptide, wherein the Cas polypeptide comprises a site-specific DNA binding domain linked to at least one base editor. In some embodiments, the CRISPR-Cas effector protein or the nucleic acid sequence encoding the same includes, but is not limited to, (i) Cas9, including SpCas9, SaCas9, SaKKH-Cas9, VQR-Cas9, StlCas9, (ii) Cpf1, including AsCpf1, LbCpf1, FnCpf1, (iii) CasX, or (iv) CasY, or any variant or derivative of the CRISPR-Cas effector protein, preferably wherein the CRISPR-Cas effector protein comprises a mutation in comparison to the respective wild type sequence so that the resulting CRISPR-Cas effector protein is converted to a single-strand specific DNA nickase, or to a DNA binding effector lacking all DNA cleavage ability, as described below. Therefore, in some embodiments, artificially modified CRISPR nucleases are envisaged, which might indeed not be any "nucleases" in the sense of double-strand cleaving enzymes, but which are nickases or nuclease-dead variants, which still have inherent DNA recognition and thus binding ability.

In some embodiments, a Cas polypeptide for use as a CRISPR-Cas effector protein as described above can be engineered to alter one or more properties of the Cas polypeptide. For example, in some embodiments, the Cas polypeptide comprises altered enzymatic properties, e.g., altered nuclease activity, (as compared with a naturally occurring or other reference Cas molecule) or altered helicase activity. In some embodiments, an engineered Cas polypeptide can have an alteration that alters its size, e.g., a deletion of amino acid sequence that reduces its size without significant effect on another property of the Cas polypeptide. In some embodiments, an engineered Cas polypeptide comprises an alteration that affects PAM recognition. For example, an engineered Cas polypeptide can be altered to recognize a PAM sequence other than the PAM sequence recognized by the corresponding wild type Cas protein. In some embodiments, the targeted base-editing system comprises a Cas protein as a CRISPR-associated effector domain.

Cas polypeptides with desired properties can be made in a number of ways, including alteration of a naturally occurring Cas polypeptide or parental Cas polypeptide, to provide a mutant or altered Cas polypeptide having a desired property. For example, one or more mutations can be introduced into the sequence of a parental Cas polypeptide (e.g., a naturally occurring or engineered Cas polypeptide). Such mutations and differences may comprise substitutions (e.g., conservative substitutions or substitutions of non-essential amino acids); insertions; or deletions. In some embodiments, a mutant Cas polypeptide comprises one or more mutations (e.g., at least 1, 2, 3, 4, 5, 10, 15, 20, 30, 40 or 50 mutations) relative to a parental Cas polypeptide.

In an embodiment, a mutant Cas polypeptide comprises a cleavage property that differs from a naturally occurring Cas polypeptide. In some embodiments, the Cas is a deactivated Cas (dCas) mutant, which is catalytically dead. In such embodiments, the Cas polypeptide does not comprise any intrinsic enzymatic activity and is unable to mediate target nucleic acid cleavage. In such embodiments, the dCas is fused with a heterologous protein that is capable of modifying the target nucleic acid in a non-cleavage based manner. In some embodiments, the targeted base-editing system comprises a Cas protein as a CRISPR-associated effector domain.

In some embodiments, the dCas is a dCas9 mutant. In some embodiments, a dCas protein is fused to base deaminase domains (e.g., cytidine deaminase, or adenosine deaminase). In some such cases, the dCas fusion protein is targeted by the gRNA to a specific location (i.e., sequence) in the target nucleic acid and exerts locus-specific modification such as replacing C with T (or G with A) if the fusion protein has cytidine deaminase activity) or replacing A with G (or T with C) if the fusion protein has adenosine deaminase activity.

In some embodiments, the dCas is a dCas13 mutant (Konermann et al., *Cell* 173 (2018), 665-676). These dCas13 mutants can then be fused to enzymes that modify RNA, including adenosine deaminases (e.g., ADAR1 and ADAR2). Adenosine deaminases convert adenine to inosine, which the translational machinery treats like guanine, thereby creating a functional A to G change in the target sequence.

In some embodiments, the CRISPR-associated effector protein is Cas9 endonuclease. In some embodiments, the CRISPR-associated effector protein is a CRISPR-Cas variant, which is dCas9 mutant or nCas9 nickase mutant. The Cas9 endonuclease has a DNA cleavage domain containing two subdomains: i) the RuvC subdomain cleaving the non-complementary single-stranded chain and ii) the HNH nuclease subdomain cleaving the chain that is complementary to gRNA. Mutations in these subdomains can inactivate Cas9 endonuclease to form deactivated Cas9 (dCas9), which is interchangeably used with "catalytically dead Cas9". The nuclease-inactivated Cas9 retains DNA binding capacity directed by gRNA. Thus, in principle, when fused with an additional protein, the dCas9 can simply target said additional protein to almost any DNA sequence through co-expression with appropriate guide RNA. For example, catalytically dead Cas9 (dCas9), which contains Asp10Ala (D10A) and His840Ala (H840A) mutations that inactivate its nuclease activity, retains its ability to bind DNA in a guide RNA-programmed manner, but does not cleave the DNA backbone (Komor et al., nature (2016), Vol 533:420-424). In some embodiments, conjugation of dCas9 with an enzymatic or chemical catalyst that mediates the direct conversion of one base to another could enable RNA-programmed DNA base editing.

In some embodiments, the mutant Cas9 is a Cas9 nickase (nCas9) mutant. Cas9 nickase mutants comprise only one catalytically active domain (either the RuvC domain (D10A) or the HNH domain (H840A)). The Cas9 nickase mutants retain DNA binding based on gRNA specificity, but are capable of cutting only one strand of DNA resulting in a single-strand break (e.g. a "nick"). In some embodiments, two complementary Cas9 nickase mutants (e.g., one Cas9 nickase mutant with an inactivated RuvC domain and one Cas9 nickase mutant with an inactivated HNH domain) are expressed in the same cell with two gRNAs corresponding to two respective target sequences; one target sequence on the sense DNA strand, and one on the antisense DNA strand. This dual-nickase system results in staggered double stranded breaks and can increase target specificity, as it is unlikely that two off-target nicks will be generated close enough to generate a double stranded break. In some embodiments, a Cas9 nickase mutant is co-expressed with a nucleic acid repair template to facilitate the incorporation of an exogenous nucleic acid sequence by homology-directed repair.

The dCas9 of the present disclosure can be derived from Cas9 of different species, for example, derived from S. pyogenes Cas9 (SpCas9). Mutations in both the RuvC subdomain and the HNH nuclease subdomain of the SpCas9 (includes, for example, D10A and H840A mutations) inactivate S. pyogenes Cas9 nuclease, resulting in a nuclease-dead/catalytically dead Cas9 (dCas9). In some embodiments of the present disclosure, the nuclease-inactivated Cas9 comprises the dCas9. In some preferred embodiments, the nuclease-inactivated Cas9 comprises.

Inactivation of one of the subdomains by mutation allows Cas9 to gain nickase activity, i.e., resulting in a Cas9 nickase (nCas9), for example, nCas9 with a D10A mutation only.

In some embodiments, the nuclease-inactivated Cas9 comprises amino acid substitutions D10A and/or H840A relative to wild type Cas9. In some embodiments, the nuclease-inactivated Cas9 of the present disclosure loses nuclease activity completely, which is catalytically dead. In such embodiments, the nuclease-inactivated Cas9 is the dCas9 with D10A and H840A. Therefore, the term "nuclease-inactivated Cas9" refers to dCas9 and/or nCas9.

In some embodiments, a nuclease-inactivated Cas9 useful with this invention may comprises nickase activity. In some embodiments, the nuclease-inactivated Cas9 is a Cas9 nickase that retains the cleavage activity of the HNH subdomain of Cas9, whereas the cleavage activity of the RuvC subdomain is inactivated. For example, the nuclease-inactivated Cas9 contains an amino acid substitution D10A relative to wild type Cas9. In some embodiments, the nuclease-inactivated Cas9 is a nCas9 with D10A only. In some embodiments, the nuclease-inactivated Cas9 comprises the nCas9.

In some embodiments, the Cas polypeptides described herein can be engineered to alter the PAM/PFS specificity of the Cas polypeptide. In some embodiments, a mutant Cas polypeptide has a PAM/PFS specificity that is different from the PAM/PFS specificity of the parental Cas polypeptide. For example, a naturally occurring Cas protein can be modified to alter the PAM/PFS sequence that the mutant Cas polypeptide recognizes to decrease off target sites, improve specificity, or eliminate a PAM/PFS recognition requirement. In some embodiments, a Cas protein can be modified to increase the length of the PAM/PFS recognition sequence. In some embodiments, the length of the PAM recognition sequence is at least 4, 5, 6, 7, 8, 9, 10 or 15 amino acids in length. Cas polypeptides that recognize different PAM/PFS sequences and/or have reduced off-target activity can be generated using directed evolution. Exemplary methods and systems that can be used for directed evolution of Cas polypeptides are described, e.g., in Esvelt et al. *Nature* 2011, 472 (7344): 499-503. Exemplary Cas mutants are described in International PCT Publication No. WO 2015/161276 and Konermann et al., *Cell* 173 (2018), 665-676, which are incorporated herein by reference in their entireties.

The term "CRISPR complex", "CRISPR endonuclease complex", "CRISPR Cas complex", or "CRISPR-gRNA complex" are used interchangeably herein. "CRISPR complex" refers to, for example, a Cas9 nuclease and/or other CRISPR-associated effector (e.g., Cas12a/Cpf1) complexed with a guide RNA (gRNA). The term "CRISPR complex" thus refers to a combination of CRISPR endonuclease and guide RNA (and any other CRISPR nucleotide sequences/polypeptides) capable of inducing a double stranded break at a CRISPR landing site. In some embodiments, "CRISPR complex" of the present disclosure refers to a combination of catalytically dead Cas9 protein and guide RNA capable of targeting a target sequence, but not capable of inducing a double stranded break at a CRISPR landing site because it loses a nuclease activity. In other embodiments, "CRISPR complex" of the present disclosure refers to a combination of Cas9 nickase and guide RNA capable of introducing gRNA-targeted single-strand breaks in DNA instead of the doublestrand breaks created by wild type Cas enzymes.

As used herein, the term "directing sequence-specific binding" in the context of CRISPR complexes refers to a guide RNA's ability to recruit a CRISPR endonuclease and/or a CRISPR-Cas effector protein to a CRISPR landing site.

As used herein, the term "deaminase" refers to an enzyme that catalyzes the deamination reaction. In some embodiments of the present disclosure, the deaminase refers to a cytidine deaminase, which catalyzes the deamination of a cytidine or a deoxycytidine to a uracil or a deoxyuridine, respectively. In other embodiments of the present disclosure, the deaminase refers to an adenosine deaminase, which catalyzes the deamination of an adenine to form hypoxanthine (in the form of its nucleoside inosine), which is read as guanine by DNA polymerase.

In some embodiments, a deaminase domain is fused to the N-terminus of the nuclease-inactivated Cas9 domain. In some embodiments, a deaminase domain is fused to the C-terminus of the nuclease-inactivated Cas9 domain. In some embodiments, a deaminase domain and a nuclease inactivated Cas9 domain are fused through a linker. A linker can be a non-functional amino acid or amino acid sequence, optionally having no secondary or higher structure, N-terminus and one or more NLSs at the C-terminus. Where there are more than one NLS, each NLS may be selected as independent from other NLSs. In some embodiments, the targeted base-editing fusion protein may comprise two NLSs, for example, the two NLSs are located at the N-terminus and the C-terminus, respectively.

In some embodiments, a targeted base modification is a conversion of any nucleotide C, A, T, or G, to any other nucleotide. Any one of a C, A, T or G nucleotide can be exchanged in a site-directed way as mediated by a base editor, or a catalytically active fragment thereof, to another nucleotide. A base editing complex can comprise any base editor, or a base editor domain or catalytically active fragment thereof, which can convert a nucleotide of interest into any other nucleotide of interest in a targeted way.

In some embodiments, a CRISPR-Cas effector protein may be temporarily or permanently linked to at least one base editor to form a targeted base editing complex, which is a base editing fusion protein, wherein the base editing complex mediates the at least one targeted base modification. A CRISPR-associated effector may be non-covalently (temporarily) or covalently (permanently) be attached to at least one base editor. Any component of the at least one base editor can be temporarily or permanently linked to the at least one CRISPR-associated effector.

In some embodiments, a base editing complex according to the present disclosure can comprise at least one cytidine deaminase, or a catalytically active fragment thereof. The at least one base editing complex can comprise the cytidine deaminase, or a domain thereof in the form of a catalytically active fragment, as base editor. In some embodiments, a base editing domain according to the present disclosure can comprise at least one adenine deaminase, or a catalytically active fragment thereof. The at least one base editing complex can comprise the adenine deaminase, or a domain thereof in the form of a catalytically active fragment, as base editor.

Any deaminase domain/polypeptide useful for base editing may be used with this invention. In some embodiments, the deaminase domain may be a cytosine deaminase domain or an adenine deaminase domain.

A cytosine deaminase (or cytidine deaminase) useful with this invention may be any known or later identified cytosine deaminase from any organism (see, e.g., U.S. Pat. No. 10,167,457 and Thuronyi et al. *Nat. Biotechnol.* 37:1070-1079 (2019), each of which is incorporated by reference herein for its disclosure of cytosine deaminases). In some embodiments, a cytidine deaminase comprises the wild type amino acid sequence of a cytosine deaminase. In some embodiments, the cytidine deaminase comprises one or more mutations in the cytosine deaminase sequence, such that the editing efficiency, and/or substrate editing preference of the cytosine deaminase is changed according to specific needs.

Certain mutations of APOBEC 1 and APOBEC3 proteins have been described in Kim et al., Nature Biotechnology (2017) 35 (4): 371-377 and Harris et al. *Mol. Cell* (2002) 10:1247-1253, each of which is incorporated herein by reference in its entirety. Additional cytidine deaminases are disclosed in WO2017/070632 and WO2018/213726, each of which is incorporated herein by reference in its entirety.

Cytosine deaminases can catalyze the hydrolytic deamination of cytidine or deoxycytidine to uridine or deoxyuridine, respectively. Thus, in some embodiments, a deaminase or deaminase domain useful with this invention may be a cytidine deaminase domain, catalyzing the hydrolytic deamination of cytosine to uracil. In some embodiments, a cytosine deaminase may be a variant of a naturally-occurring cytosine deaminase, including but not limited to a primate (e.g., a human, monkey, chimpanzee, gorilla), a dog, a cow, a rat or a mouse. Thus, in some embodiments, an cytosine deaminase useful with the invention may be about 70% to about 100% identical to a wild type cytosine deaminase (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical, and any range or value therein, to a naturally occurring cytosine deaminase).

Cytidine deaminase is capable of targeting cytosine in a DNA single strand. In some embodiments, a cytodine deaminase may edit on a single strand present outside of the binding component e.g. bound Cas9 and/or Casl3. In some embodiments, a cytidine deaminase may edit at a localized bubble, such as a localized bubble formed by a mismatch at the target edit site but the guide sequence.

In some embodiments, the cytidine deaminase protein recognizes and converts one or more target cytosine residue(s) in a single-stranded bubble of a DNA-RNA heteroduplex into uracil residues(s). In some embodiments, the cytidine deaminase protein recognizes a binding window on the single-stranded bubble of a DNA-RNA heteroduplex. In some embodiments, the binding window contains at least one target cytosine residue(s). In some embodiments, the binding window is in the range of about 3 bp to about 100 bp. In some embodiments, the binding window is in the range of about 5 bp to about 50 bp. In some embodiments, the binding window is in the range of about 10 bp to about 30 bp. In some embodiments, the binding window is about 1 bp, 2 bp, 3 bp, 5 bp, 7 bp, 10 bp, 15 bp, 20 bp, 25 bp, 30 bp, 40 bp, 45 bp, 50 bp, 55 bp, 60 bp, 65 bp, 70 bp, 75 bp, 80 bp, 85 bp, 90 bp, 95 bp, or 100 bp.

In some embodiments, a cytosine deaminase useful with the invention may be an apolipoprotein B mRNA-editing complex (APOBEC) family deaminase. In some embodiments, the cytosine deaminase may be an APOBEC1 deaminase, an APOBEC2 deaminase, an APOBEC3A deaminase, an APOBEC3B deaminase, an APOBEC3C deaminase, an APOBEC3D deaminase, an APOBEC3F deaminase, an APOBEC3G deaminase, an APOBEC3H deaminase, an APOBEC4 deaminase, a human activation induced deaminase (hAID), an rAPOBEC1, FERNY, and/or a CDA1, optionally a pmCDA1, an atCDA1 (e.g., At2g19570), and evolved versions of the same (e.g., SEQ ID NO:27 or SEQ ID NO:28). In some embodiments, the cytidine deaminase comprises human APOBEC1 full protein (hAPOBECI) or the deaminase domain thereof (hAPOBECI-D) or a C-terminally truncated version thereof (hAPOBEC-T). In some embodiments, the cytidine deaminase is an APOBEC family member that is homologous to hAPOBECI, hAPOBEC-D or hAPOBEC-T. In some embodiments, the cytidine deaminase comprises human AID1 full protein (hAID) or the deaminase domain thereof (hAID-D) or a C-terminally truncated version thereof (hAID-T). In some embodiments, the cytidine deaminase is an AID family member that is homologous to hAID, hAID-D or hAID-T. In some embodiments, the hAIDT is a hAID which is C-terminally truncated by about 20 amino acids. In some embodiments, the cytosine deaminase may be an APOBEC1 deaminase. In some embodiments, the cytosine deaminase may be an APOBEC3A deaminase. In some embodiments, the cytosine deaminase may be an CDA1 deaminase. In some embodiments, the cytosine deaminase may be a FERNY deaminase. In some embodiments, the cytosine deaminase may be an APOBEC1 deaminase having the amino acid sequence of SEQ ID NO:23. In some embodiments, the cytosine deaminase may be an APOBEC3A deaminase having the amino acid sequence of SEQ ID NO:24. In some embodiments, the cytosine deaminase may be an CDA1 deaminase, optionally a CDA1 having the amino acid sequence of SEQ ID NO:25. In some embodiments, the cytosine deaminase may be a FERNY deaminase, optionally a FERNY having the amino acid sequence of SEQ ID NO:26. In some embodiments, a cytosine deaminase useful with the invention may be about 70% to about 100% identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% identical) to the amino acid sequence of a naturally occurring cytosine deaminase (e.g., an evolved deaminase). In some embodiments, a cytosine deaminase useful with the invention may be about 70% to about 99.5% identical (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 99.5% identical) to the amino acid sequence of SEQ ID NO:23, SEQ ID NO:24, SEQ ID NO:25 or SEQ ID NO:26 (e.g., at least 80%, at least 85%, at least 90%, at least 92%, at least 95%, at least 96%, at least 97%, at least 98%, at least 99%, or at least 99.5% identical to the amino acid sequence of SEQ ID NO:23, SEQ ID NO:24, SEQ ID NO:25, SEQ ID NO:26, SEQ ID NO:27 or SEQ ID NO:28). In some embodiments, a polynucleotide encoding a cytosine deaminase may be codon optimized for expression in a plant and the codon optimized polypeptide may be about 70% to 99.5% identical to the reference polynucleotide.

As used herein, the term "glycosylase" refers to a family of enzymes involved in base excision repair, classified under EC number EC 3.2.2. Base excision repair is the mechanism by which damaged bases in DNA are removed and replaced. DNA glycosylases catalyze the first step of this process. They remove the damaged nitrogenous base while leaving the sugar-phosphate backbone intact, creating an apurinic/apyrimidinic site, commonly referred to as an AP site. This is accomplished by removing the damaged base from the double helix followed by cleavage of the N-glycosidic bond. In some embodiments, in an expectation of affording a mutation introduction tendency different from that of deaminase and the like, a base excision reaction by hydrolysis of N-glycosidic bond of DNA, and then inducing mutation introduction in a repair process of cells may be used. In some aspects, an enzyme having cytosine-DNA glycosylase (CDG) activity or thymine-DNA glycosylase (TDG) activity may be used. In some aspects, a mutant of yeast mitochondrial uracil-DNA glycosylase (UNG 1), may be used as an enzyme that performs such base excision reaction. Nishida et al., US 2017/0321210 A1, published on Nov. 9, 2017, is incorporated by reference herein.

Base excision repair may be inhibited by molecules that bind the edited strand, block the edited base, inhibit uracil DNA glycosylase, inhibit base excision repair, protect the edited base, and/or promote fixing of the non-targeted strand. Accordingly, the use of a base excision repair (BER) inhibitor described herein can increase the editing efficiency of a cytidine deaminase that is capable of catalyzing a C to U change.

Accordingly, a nucleic acid construct of this invention may further encode a uracil glycosylase inhibitor (UGI) (e.g., uracil-DNA glycosylase inhibitor) polypeptide/domain. Thus, in some embodiments, a nucleic acid construct encoding a CRISPR-Cas effector protein and a cytosine deaminase domain (e.g., encoding a fusion protein comprising a CRISPR-Cas effector protein domain fused to a cytosine deaminase domain, and/or a CRISPR-Cas effector protein domain fused to a peptide tag or to an affinity polypeptide capable of binding a peptide tag and/or a deaminase protein domain fused to a peptide tag or to an affinity polypeptide capable of binding a peptide tag) may further encode a uracil-DNA glycosylase inhibitor (UGI), optionally wherein the UGI may be codon optimized for expression in a plant. In some embodiments, the invention provides fusion proteins comprising a CRISPR-Cas effector polypeptide, a deaminase domain, and a UGI and/or one or more polynucleotides encoding the same, optionally wherein the one or more polynucleotides may be codon optimized for expression in a plant. In some embodiments, the invention provides fusion proteins, wherein a CRISPR-Cas effector polypeptide, a deaminase domain, and a UGI may be fused to any combination of peptide tags and affinity polypeptides as described herein, thereby recruiting the deaminase domain and UGI to the CRISPR-Cas effector polypeptide and a target nucleic acid. In some embodiments, a guide nucleic acid may be linked to a recruiting RNA motif and one or more of the deaminase domain and/or UGI may be fused to an affinity polypeptide that is capable of interacting with the recruiting RNA motif, thereby recruiting the deaminase domain and UGI to a target nucleic acid.

A "uracil glycosylase inhibitor" useful with the invention may be any protein that is capable of inhibiting a uracil-DNA glycosylase base-excision repair enzyme.

Suitable uracil glycosylase inhibitor (UGI) protein and nucleotide sequences are provided herein and additional suitable UGI sequences are known to those in the art, and include, for example, those published in Wang et al. *J. Biol. Chem.* 264:1 163-1 171 (1989); Lundquist et al., *J. Biol. Chem.* 272:21408-21419 (1997); Ravishankar et al. *Nucleic Acids Res.* 26:4880-4887 (1998); and Putnam et al. *J. Mol. Biol.* 287:331-346 (1999), each of which incorporated herein by reference. Additional embodiments of the uracil glycosylase inhibitor (UGI) are disclosed in WO2018/086623, WO2018/205995, WO2017/70632, and WO2018/213726, each of which is incorporated herein by reference in its entirety.

In some embodiments, the uracil glycosylase inhibitor is the uracil DNA glycosylase inhibitor of *Bacillus subtilis* bacteriophage PBS1 or an active fragment thereof, such as an 83 residue protein of *Bacillus subtilis* bacteriophage PBS1. In some embodiments, the UGI domain comprises a wild type UGI or a UGI. In some embodiments, the UGI proteins provided herein include fragments of UGI and proteins homologous to a UGI or a UGI fragment.

Additional proteins may be uracil glycosylase inhibitors. For example, other proteins that are capable of inhibiting (e.g., sterically blocking) a uracil-DNA glycosylase base-excision repair enzyme are within the scope of this disclosure. Additionally, any proteins that block or inhibit base-excision repair as also within the scope of this disclosure. In some embodiments, a protein that binds DNA is used. In another embodiment, a substitute for UGI is used. In some embodiments, a uracil glycosylase inhibitor is a protein that binds single-stranded DNA. For example, a uracil glycosylase inhibitor may be a *Erwinia tasmaniensis* single-stranded binding protein. In some embodiments, a uracil glycosylase inhibitor is a protein that binds uracil. In some embodiments, a uracil glycosylase inhibitor is a protein that binds uracil in DNA. In some embodiments, a uracil glycosylase inhibitor is a catalytically inactive uracil DNA-glycosylase protein. In some embodiments, a uracil glycosylase inhibitor is a catalytically inactive uracil DNA-glycosylase protein that does not excise uracil from the DNA. As another example, a uracil glycosylase inhibitor is a catalytically inactive UDG.

In some embodiments, a UGI domain comprises a wild type UGI or a fragment thereof. In some embodiments, a UGI domain useful with the invention may be about 70% to about 100% identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% identical and any range or value therein) to the amino acid sequence of a naturally occurring UGI domain. In some embodiments, a UGI domain may comprise the amino acid sequence of SEQ ID NO:35or a polypeptide having about 70% to about 99.5% sequence identity to the amino acid sequence of SEQ ID NO:35 (e.g., at least 80%, at least 85%, at least 90%, at least 92%, at least 95%, at least 96%, at least 97%, at least 98%, at least 99%, or at least 99.5% identical to the amino acid sequence of SEQ ID NO:35). For example, in some embodiments, a UGI domain may comprise a fragment of the amino acid sequence of SEQ ID NO:35 that is 100% identical to a portion of consecutive nucleotides (e.g., 10, 15, 20, 25, 30, 35, 40, 45, 50, 55, 60, 65, 70, 75, 80 consecutive nucleotides; e.g., about 10, 15, 20, 25, 30, 35, 40, 45, to about 50, 55, 60, 65, 70, 75, 80 consecutive nucleotides) of the amino acid sequence of SEQ ID NO:35. In some embodiments, a UGI domain may be a variant of a known UGI (e.g., SEQ ID NO:35) having about 70% to about 99.5% sequence identity (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% sequence identity, and any range or value therein) to the known UGI. In some embodiments, a polynucleotide encoding a UGI may be codon optimized for expression in a plant (e.g., a plant) and the codon optimized polypeptide may be about 70% to about 99.5% identical to the reference polynucleotide.

An adenine deaminase (or adenosine deaminase) useful with this invention may be any known or later identified adenine deaminase from any organism (see, e.g., U.S. Pat. No. 10,113,163, which is incorporated by reference herein for its disclosure of adenine deaminases). Adenosine deaminases (e.g. engineered adenosine deaminases, evolved adenosine deaminases) useful with this invention may be from any organism, such as a bacterium. In some embodiments, the deaminase or deaminase domain is a variant of a naturally-occurring deaminase from an organism. In some embodiments, the deaminase or deaminase domain does not occur in nature. For example, in some embodiments, the deaminase or deaminase domain is at least 50%, at least 55%, at least 60%, at least 65%, at least 70%, at least 75% at least 80%, at least 85%, at least 90%, at least 95%, at least 96%, at least 97%, at least 98%, at least 99%, or at least 99.5% identical to a naturally-occurring deaminase. In some embodiments, the adenosine deaminase is from a bacterium, such as, *E. coli, S. aureus, S. typhi, S. putrefaciens, H. influenzae*, or *C. crescentus*.

Adenine deaminases catalyze the hydrolytic deamination of adenine or adenosine. In some embodiments, the adenine deaminase may catalyze the hydrolytic deamination of adenosine or deoxyadenosine to inosine or deoxyinosine, respectively. In some embodiments, the adenosine deaminase may catalyze the hydrolytic deamination of adenine or adenosine in DNA. In some embodiments, an adenine deaminase encoded by a nucleic acid construct of the invention may generate an A→G conversion in the sense (e.g., "+"; template) strand of the target nucleic acid or a T→C conversion in the antisense (e.g., "−", complementary) strand of the target nucleic acid.

In some embodiments, an adenosine deaminase may be a variant of a naturally-occurring adenine deaminase. Thus, in some embodiments, an adenosine deaminase may be about 70% to 100% identical to a wild type adenine deaminase (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical, and any range or value therein, to a naturally occurring adenine deaminase). In some embodiments, the deaminase or deaminase does not occur in nature and may be referred to as an engineered, mutated or evolved adenosine deaminase. Thus, for example, an engineered, mutated or evolved adenine deaminase polypeptide or an adenine deaminase domain may be about 70% to 99.9% identical to a naturally occurring adenine deaminase polypeptide/domain (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8% or 99.9% identical, and any range or value therein, to a naturally occurring adenine deaminase polypeptide or adenine deaminase domain). In some embodiments, the adenosine deaminase may be from a bacterium, (e.g., *Escherichia coli, Staphylococcus aureus, Haemophilus influenzae, Caulobacter crescentus*, and the like). In some embodiments, a polynucleotide encoding an adenine deaminase polypeptide/domain may be codon optimized for expression in a plant.

In some embodiments, adenosine deaminases useful with the invention include, but are not limited to, members of the enzyme family known as adenosine deaminases that act on RNA (ADARs), members of the enzyme family known as adenosine deaminases that act on tRNA (ADATs), and other adenosine deaminase domain-containing (ADAD) family members. According to the present disclosure, the adenosine deaminase is capable of targeting adenine in a RNA/DNA heteroduplex. Indeed, Zheng et al. (*Nucleic Acids Res.* 2017, 45 (6): 3369-3377) has demonstrated that ADARs can carry out adenosine to inosine editing reactions on RNA/DNA heteroduplexes. In particular embodiments, the adenosine deaminase has been modified to increase its ability to edit DNA in a RNA/DNA heteroduplex.

In some embodiments, an adenosine deaminase may be derived from one or more metazoa species, including but not limited to, mammals, birds, frogs, squids, fish, flies and worms. In some embodiments, the adenosine deaminase is a human, squid or *Drosophila* adenosine deaminase. In some embodiments, the adenosine deaminase is a human ADAR, including hADARI, hADAR2, hADAR3. In some embodiments, the adenosine deaminase is a *Caenorhabditis elegans* ADAR protein, including ADR-1 and ADR-2. In some embodiments, the adenosine deaminase is a *Drosophila* ADAR protein, including dAdar. In some embodiments, the adenosine deaminase is a squid Loligo pealeil ADAR protein, including sqADAR2a and sqADAR2b. In some embodiments, the adenosine deaminase is a human ADAT protein. In some embodiments, the adenosine deaminase is a *Drosophila* ADAT protein. In some embodiments, the adenosine deaminase is a human ADAD protein, including TE R (hADADI) and TE RL (hADAD2). In some embodiments, the adenosine deaminase is mouse ADA (See Grunebaum et al., *Curr. Opin. Allergy Clin. Immunol.* 13:630-638 (2013)) or human ADAT2 (See Fukui et al., *J. Nucleic Acids* 2010:260512 (2010)), each of which is incorporated herein by reference in its entirety. Additional embodiments of the adenosine deaminase are disclosed in U.S. Patent No. U.S. Pat. No. 10,113,163 and WO2018/213708, each of which is incorporated herein by reference in its entirety.

In some embodiments, an adenine deaminase domain may be a wild type tRNA-specific adenosine deaminase domain, e.g., a tRNA-specific adenosine deaminase (TadA) and/or a mutated/evolved adenosine deaminase domain, e.g., mutated/evolved tRNA-specific adenosine deaminase domain (TadA*). In some embodiments, a TadA domain may be from *E. coli*. In some embodiments, the TadA may be modified, e.g., truncated, missing one or more N-terminal and/or C-terminal amino acids relative to a full-length TadA (e.g., 1, 2, 3, 4, 5, 6, 7, 8, 9, 10, 11, 12, 13, 14, 15, 6, 17, 18, 19, or 20 N-terminal and/or C terminal amino acid residues may be missing relative to a full length TadA. In some embodiments, a TadA polypeptide or TadA domain does not comprise an N-terminal methionine. In some embodiments, a TadA polypeptide or TadA domain does not comprise an N-terminal methionine. In some embodiments, the adenosine deaminase is a TadA deaminase. In some embodiments, the TadA deaminase is an *E. coli* TadA deaminase (ecTadA). In some embodiments, the TadA deaminase is a truncated *E. coli* TadA deaminase. For example, the truncated ecTadA may be missing one or more N-terminal amino acids relative to a full-length ecTadA. In some embodiments, an adenosine deaminase is as described in Gaudelli et al. (*Nat Biotechnol* (2020)) and Richter et al. (*Nat Biotechnol* (2020)). In some embodiments, the truncated ecTadA may be missing 1, 2, 3, 4, 5, 6, 7, 8, 9, 10, 11, 12, 13, 14, 15, 6, 17, 18, 19, or 20 N-terminal amino acid residues relative to the full length ecTadA. In some embodiments, the truncated ecTadA may be missing 1, 2, 3, 4, 5, 6, 7, 8, 9, 10, 11, 12, 13, 14, 15, 6, 17, 18, 19, or 20 C-terminal amino acid residues relative to the full length ecTadA. In some embodiments, the ecTadA deaminase does not comprise an N-terminal methionine In some embodiments, a wild type *E. coli* TadA comprises the amino acid sequence of SEQ ID NO:30. In some embodiments, a mutated/evolved *E. coli* TadA* comprises the amino acid sequence of SEQ ID NOs: 31-34 (e.g., SEQ ID NOs: 31, 32, 33, or 34). In some embodiments, a polynucleotide encoding a TadA/TadA* may be codon optimized for expression in a plant.

A cytosine deaminase catalyzes cytosine deamination and results in a thymidine (through a uracil intermediate), causing a C to T conversion, or a G to A conversion in the complementary strand in the genome. Thus, in some embodiments, the cytosine deaminase encoded by the polynucleotide of the invention generates a C→T conversion in the sense (e.g., "+"; template) strand of the target nucleic acid or a G-A conversion in antisense (e.g., "−", complementary) strand of the target nucleic acid.

In some embodiments, the adenine deaminase encoded by the nucleic acid construct of the invention generates an A→G conversion in the sense (e.g., "+"; template) strand of the target nucleic acid or a T→C conversion in the antisense (e.g., "−", complementary) strand of the target nucleic acid.

In some aspects, methods for targeted deamination of adenine or cytidine in a target nucleic acid are provided, more particularly in a locus of interest (e.g., a gene encoding an enzyme involved in glucosinolate biosynthesis or breakdown, e.g., a myrosinase gene, a CYP79F1 gene, and/or an AOP2 gene). An adenosine deaminase (AD) protein and/or a cytidine deaminase (CD) protein may be recruited specifically to the target adenine or cytidine in the locus of interest by a CRISPR-Cas complex which can specifically bind to a target sequence. In order to achieve this, the adenosine deaminase protein and/or cytidine deaminase protein can either be covalently linked to the CRISPR-Cas enzyme or may be provided as a separate protein, but adapted so as to ensure recruitment thereof to the CRISPR-Cas complex.

In some embodiments, recruitment of an adenosine deaminase and/or cytidine deaminase to a target locus is ensured by fusing the adenosine deaminase or catalytic domain thereof and/or the cytosine deaminase or catalytic domain thereof to the CRISPR-Cas protein, which is a Cas or Cpf1 protein. Methods of generating a fusion protein from two separate proteins are known in the art and typically involve the use of spacers or linkers. The CRISPR-Cas protein can be fused to the adenosine deaminase protein or catalytic domain thereof and/or the cytosine deaminase or catalytic domain thereof on either the N- or C-terminal end thereof. In some embodiments, the CRISPR-Cas protein is a Cas or Cpf1 protein and is linked to the N-terminus of the deaminase protein or its catalytic domain.

The nucleic acid constructs of the invention encoding a base editor comprising a sequence-specific DNA binding protein and a cytosine deaminase polypeptide, and nucleic acid constructs/expression cassettes/vectors encoding the same, may be used in combination with guide nucleic acids for modifying target nucleic acid including, but not limited to, generation of C→T or G→A mutations in a target nucleic acid including, but not limited to, a plasmid sequence; generation of C→T or G→A mutations in a coding sequence to alter an amino acid identity; generation of C→T or G→A mutations in a coding sequence to generate a stop codon; generation of C→T or G→A mutations in a coding sequence to disrupt a start codon; generation of point mutations in genomic DNA to disrupt function; and/or generation of point mutations in genomic DNA to disrupt splice junctions.

The nucleic acid constructs of the invention encoding a base editor comprising a sequence-specific DNA binding protein and an adenine deaminase polypeptide, and expression cassettes and/or vectors encoding the same may be used in combination with guide nucleic acids for modifying a target nucleic acid including, but not limited to, generation of A→G or T→C mutations in a target nucleic acid including, but not limited to, a plasmid sequence; generation of A→G or T→C mutations in a coding sequence to alter an amino acid identity; generation of A→G or T→C mutations in a coding sequence to generate a stop codon; generation of A→G or T→C mutations in a coding sequence to disrupt a start codon; generation of point mutations in genomic DNA to disrupt function; and/or generation of point mutations in genomic DNA to disrupt splice junctions.

The nucleic acid constructs of the invention comprising a CRISPR-Cas effector protein or a fusion protein thereof may be used in combination with a guide RNA (gRNA, CRISPR array, CRISPR RNA, crRNA), designed to function with the encoded CRISPR-Cas effector protein or domain, to modify a target nucleic acid. A guide nucleic acid useful with this invention comprises at least one spacer sequence and at least one repeat sequence. The guide nucleic acid is capable of forming a complex with the CRISPR-Cas nuclease domain encoded and expressed by a nucleic acid construct of the invention and the spacer sequence is capable of hybridizing to a target nucleic acid, thereby guiding the complex (e.g., a CRISPR-Cas effector fusion protein (e.g., CRISPR-Cas effector domain fused to a deaminase domain and/or a CRISPR-Cas effector domain fused to a peptide tag or an affinity polypeptide to recruit a deaminase domain and optionally, a UGI) to the target nucleic acid, wherein the target nucleic acid may be modified (e.g., cleaved or edited) or modulated (e.g., modulating transcription) by the deaminase domain.

As an example, a nucleic acid construct encoding a Cas9 domain linked to a cytosine deaminase domain (e.g., fusion protein) may be used in combination with a Cas9 guide nucleic acid to modify a target nucleic acid, wherein the cytosine deaminase domain of the fusion protein deaminates a cytosine base in the target nucleic acid, thereby editing the target nucleic acid. In a further example, a nucleic acid construct encoding a Cas9 domain linked to an adenine deaminase domain (e.g., fusion protein) may be used in combination with a Cas9 guide nucleic acid to modify a target nucleic acid, wherein the adenine deaminase domain of the fusion protein deaminates an adenosine base in the target nucleic acid, thereby editing the target nucleic acid.

Likewise, a nucleic acid construct encoding a Cas 12a domain (or other selected CRISPR-Cas nuclease, e.g., C2c1, C2c3, Cas12b, Cas12c, Cas12d, Cas12e, Cas13a, Cas13b, Cas13c, Cas13d, Casl, CasIB, Cas2, Cas3, Cas3', Cas3", Cas4, Cas5, Cas6, Cas7, Cas8, Cas9 (also known as Csn1 and Csx12), Cas10, Csy1, Csy2, Csy3, Cse1, Cse2, Cscl, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4 (dinG), and/or Csf5) linked to a cytosine deaminase domain or adenine deaminase domain (e.g., fusion protein) may be used in combination with a Cas12a guide nucleic acid (or the guide nucleic acid for the other selected CRISPR-Cas nuclease) to modify a target nucleic acid, wherein the cytosine deaminase domain or adenine deaminase domain of the fusion protein deaminates a cytosine base in the target nucleic acid, thereby editing the target nucleic acid.

Also provided herein are "guide nucleic acids" (e.g., guide RNA," "gRNA," "CRISPR RNA/DNA," "CRISPR," "crRNA" or "crDNA) that direct a site-directed modifying polypeptide to a specific target nucleic acid sequence. A guide nucleic acid comprises a nucleic acid-targeting segment and protein-binding segment. The nucleic acid-targeting segment of guide nucleic acid comprises a nucleotide sequence that is complementary to a sequence in the target nucleic acid sequence. As such, the nucleic acid-targeting segment of a guide nucleic acid interacts with a target nucleic acid in a sequence-specific manner via hybridization (i.e., base pairing), and the nucleotide sequence of the nucleic acid-targeting segment determines the location within the target nucleic acid that the guide nucleic acid will bind. The nucleic acid-targeting segment of a guide nucleic acid can be modified (e.g., by genetic engineering) to hybridize to any desired sequence within a target nucleic acid sequence.

The protein-binding segment of a guide nucleic acid interacts with a site-directed modifying polypeptide (e.g., a Cas protein, a Cas12a protein) to form a complex. The guide nucleic acid guides the bound polypeptide to a specific nucleotide sequence within target nucleic acid via the above-described nucleic acid-targeting segment. The protein-binding segment of a guide nucleic acid comprises two stretches of nucleotides that are complementary to one another and which form a double stranded RNA duplex.

In some embodiments, a guide nucleic acid comprises two separate nucleic acid (RNA, DNA molecules. In such embodiments, each of the two nucleic acid molecules may comprise a stretch of nucleotides that are complementary to one another such that the complementary nucleotides of the two molecules hybridize to form the double-stranded nucleic acid duplex of the protein-binding segment. In some embodiments, a guide nucleic acid comprises a single guide RNA molecule (sgRNA) (e.g., a CRISPR and a tracr).

Accordingly, a "guide nucleic acid," used herein means a nucleic acid that comprises at least one spacer sequence, which is complementary to (and hybridizes to) a target DNA (e.g., protospacer), and at least one repeat sequence (e.g., a repeat of a Type V Cas 12a CRISPR-Cas system, or a fragment or portion thereof; a repeat of a Type II Cas9 CRISPR-Cas system, or fragment thereof; a repeat of a Type V C2c1 CRISPR Cas system, or a fragment thereof; a repeat of a CRISPR-Cas system of, for example, C2c3, Cas12a (also referred to as Cpf1), Cas12b, Cas12c, Cas12d, Cas12e, Cas13a, Cas13b, Cas13c, Cas13d, Casl, CasIB, Cas2, Cas3, Cas3', Cas3", Cas4, Cas5, Cas6, Cas7, Cas8, Cas9 (also known as Csn1 and Csx12), Cas10, Csy1, Csy2, Csy3, Cse1, Cse2, Cscl, Csc2, Csa5, Csn2, Csm2, Csm3, Csm4, Csm5, Csm6, Cmrl, Cmr3, Cmr4, Cmr5, Cmr6, Csbl, Csb2, Csb3, Csx17, Csxl4, Csx10, Csx16, CsaX, Csx3, Csxl, Csx15, Csf1, Csf2, Csf3, Csf4 (dinG), and/or Csf5, or a fragment thereof), wherein the repeat sequence may be linked to the 5' end and/or the 3' end of the spacer sequence. The design of a gRNA of this invention may be based on a Type I, Type II, Type III, Type IV, Type V, or Type VI CRISPR-Cas system.

In some embodiments, a targeted editing system (e.g., base-editing system) comprises one or two or more gRNA molecules each comprising a DNA-binding segment, wherein at least one of the nucleic acid binding segments binds to a target DNA sequence of a target gene encoding a glucosinolate biosynthetic enzyme or an enzyme that breaks down or catabolizes glucosinolates (e.g., myrosinase, AOP2, and CYP79F1) may be used to produce plants of the present disclosure. In some embodiments, the guide RNA is a single guide RNA (sgRNA). Methods of constructing suitable sgRNAs according to a given target sequence are known in the art. See e.g., Wang, Y. et al. Simultaneous editing of three homoeoalleles in hexaploid bread wheat confers heritable resistance to powdery mildew. *Nat. Biotechnol.* 32, 947-951 (2014); Shan, Q. et al. Targeted genome modification of crop plants using a CRISPR-Cas system. *Nat. Biotechnol.* 31, 686-688 (2013); Liang, Z. et al. Targeted mutagenesis in *Zea mays* using TALENs and the CRISPR/Cas system. *J Genet Genomics.* 41, 63-68 (2014).

In some embodiments, a Cas12a guide nucleic acid may comprise, from 5' to 3', a repeat sequence (full length or portion thereof ("handle"); e.g., pseudoknot-like structure) and a spacer sequence.

In some embodiments, a guide nucleic acid may comprise more than one repeat sequence-spacer sequence (e.g., 2, 3, 4, 5, 6, 7, 8, 9, 10, or more repeat-spacer sequences) (e.g., repeat-spacer-repeat, e.g., repeat-spacer-repeat-spacer-repeat-spacer-repeat-spacer-repeat-spacer, and the like). The guide nucleic acids of this invention are synthetic, human-made and not found in nature. A guide nucleic acid can be quite long and may be used as an aptamer (like in the MS2 recruitment strategy) or other RNA structures hanging off the spacer.

A "repeat sequence" as used herein, refers to, for example, any repeat sequence of a wild-type CRISPR Cas locus (e.g., a Cas9 locus, a Cas12a locus, a C2c1 locus, etc.) or a repeat sequence of a synthetic crRNA that is functional with the CRISPR-Cas effector protein encoded by the nucleic acid constructs of the invention. A repeat sequence useful with this invention can be any known or later identified repeat sequence of a CRISPR-Cas locus (e.g., Type I, Type II, Type III, Type IV, Type V or Type VI) or it can be a synthetic repeat designed to function in a Type I, II, III, IV, V or VI CRISPR-Cas system. A repeat sequence may comprise a hairpin structure and/or a stem loop structure. In some embodiments, a repeat sequence may form a pseudoknot-like structure at its 5' end (i.e., "handle"). Thus, in some embodiments, a repeat sequence can be identical to or substantially identical to a repeat sequence from wild-type Type I CRISPR-Cas loci, Type II, CRISPR-Cas loci, Type III, CRISPR-Cas loci, Type IV CRISPR-Cas loci, Type V CRISPR-Cas loci and/or Type VI CRISPR-Cas loci. A repeat sequence from a wild-type CRISPR-Cas locus may be determined through established algorithms, such as using the CRISPRfinder offered through CRISPRdb (see, Grissa et al. *Nucleic Acids Res.* 35 (Web Server issue): W52-7). In some embodiments, a repeat sequence or portion thereof is linked at its 3' end to the 5' end of a spacer sequence, thereby forming a repeat-spacer sequence (e.g., guide nucleic acid, guide RNA/DNA, crRNA, crDNA).

In some embodiments, a repeat sequence comprises, consists essentially of, or consists of at least 10 nucleotides depending on the particular repeat and whether the guide nucleic acid comprising the repeat is processed or unprocessed (e.g., about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 to 100 or more nucleotides, or any range or value therein). In some embodiments, a repeat sequence comprises, consists essentially of, or consists of about 10 to about 20, about 10 to about 30, about 10 to about 45, about 10 to about 50, about 15 to about 30, about 15 to about 40, about 15 to about 45, about 15 to about 50, about 20 to about 30, about 20 to about 40, about 20 to about 50, about 30 to about 40, about 40 to about 80, about 50 to about 100 or more nucleotides.

A repeat sequence linked to the 5' end of a spacer sequence can comprise a portion of a repeat sequence (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or more contiguous nucleotides of a wild type repeat sequence). In some embodiments, a portion of a repeat sequence linked to the 5' end of a spacer sequence can be about five to about ten consecutive nucleotides in length (e.g., about 5, 6, 7, 8, 9, 10 nucleotides) and have at least 90% sequence identity (e.g., at least about 90%, 91%, 92%, 93%, 94%, 95%, 96%, 97%, 98%, 99%, or more (e.g., 99.1, 99.2, 99.3, 99.4, 99.5, 99.6, 99.7, 99.8, 99.9, or 100%)) to the same region (e.g., 5' end) of a wild type CRISPR Cas repeat nucleotide sequence. In some embodiments, a portion of a repeat sequence may comprises a pseudoknot-like structure at its 5' end (e.g., "handle").

A "spacer sequence" as used herein is a nucleotide sequence that is complementary to a target nucleic acid (e.g., target DNA) (e.g., protospacer) (e.g., consecutive nucleo-tides of a myrosinase gene, a CYP79F1 gene or an AOP2 gene. In some embodiments, a spacer sequence useful with this invention may be complementary to a sequence (or portion thereof) having at least 80% sequence identity to any one of the nucleotide sequences of SEQ ID NOs: 66-92, SEQ ID NO: 113, SEQ ID NO:114, SEQ ID NOS: 118-127 or SEQ ID NOs: 680-742; or complementary to a portion of consecutive nucleotides encoding a sequence having at least 80% sequenced identity to any one of the amino acid sequences of SEQ ID NOs: 93-105, 115, 128-132, 617-679 or 743-786. In some embodiments, a spacer sequence may include, but is not limited to, a sequence having at least 80% identity to any one of the nucleotide sequences of SEQ ID NO:116 or SEQ ID NO:117, SEQ ID NOs: 133-140 and/or SEQ ID NOs: 106-112.

The specificity of a guide nucleic acid for a target loci is mediated by the sequence of the nucleic acid-binding segment (e.g., a spacer sequence), which comprises a sequence that is complementary to a target nucleic acid sequence within the target locus. The spacer sequence can be fully complementary or substantially complementary (e.g., at least about 70% complementary (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more (e.g., 99.1, 99.2, 99.3, 99.4, 99.5, 99.6, 99.7, 99.8, 99.9, or 100%)) to a target nucleic acid. Thus, in some embodiments, the spacer sequence can have one, two, three, four, or five mismatches as compared to the target nucleic acid, which mismatches can be contiguous or noncontiguous. In some embodiments, the spacer sequence can have 70% complementarity to a target nucleic acid. In other embodiments, the spacer nucleotide sequence can have 80% complementarity to a target nucleic acid. In still other embodiments, the spacer nucleotide sequence can have 85%, 90%, 95%, 96%, 97%, 98%, 99% or 99.5% complementarity, and the like, to the target nucleic acid (protospacer). In some embodiments, the spacer sequence is 100% complementary to the target nucleic acid. A spacer sequence may have a length from about 15 nucleotides to about 30 nucleotides (e.g., 15, 16, 17, 18, 19, 20, 21, 22, 23, 24, 25, 26, 27, 28, 29, or 30 nucleotides, or any range or value therein). Thus, in some embodiments, a spacer sequence may have complete complementarity or substantial complementarity over a region of a target nucleic acid (e.g., protospacer) that is at least about 15 nucleotides to about 30 nucleotides in length. In some embodiments, the spacer is about 20 nucleotides in length. In some embodiments, the spacer is about 21, 22, or 23 nucleotides in length.

In some embodiments, the 5' region of a spacer sequence of a guide nucleic acid may be identical to a target DNA, while the 3' region of the spacer may be substantially complementary to the target DNA (e.g., Type V CRISPR-Cas), or the 3' region of a spacer sequence of a guide nucleic acid may be identical to a target DNA, while the 5' region of the spacer may be substantially complementary to the target DNA (e.g., Type II CRISPR-Cas), and therefore, the overall complementarity of the spacer sequence to the target DNA may be less than 100%. Thus, for example, in a guide for a Type V CRISPR-Cas system, the first 1, 2, 3, 4, 5, 6, 7, 8, 9, 10 nucleotides in the 5' region (i.e., seed region) of, for example, a 20 nucleotide spacer sequence may be 100% complementary to the target DNA, while the remaining nucleotides in the 3' region of the spacer sequence are substantially complementary (e.g., at least about 70% complementary) to the target DNA. In some embodiments, the first 1 to 8 nucleotides (e.g., the first 1, 2, 3, 4, 5, 6, 7, 8, nucleotides, and any range therein) of the 5' end of the spacer sequence may be 100% complementary to the target DNA, while the remaining nucleotides in the 3' region of the spacer sequence are substantially complementary (e.g., at least about 50% complementary (e.g., 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to the target DNA.

As a further example, in a guide for a Type II CRISPR-Cas system, the first 1, 2, 3, 4, 5, 6, 7, 8, 9, 10 nucleotides substantially complementary (and hybridizes) to the spacer sequence of the CRISPR repeat-spacer sequences (e.g., guide nucleic acids, CRISPR arrays, crRNAs).

In the case of Type V CRISPR-Cas (e.g., Cas12a) systems and Type II CRISPR-Cas (Cas9) systems, the protospacer sequence is flanked by (e.g., immediately adjacent to) a protospacer adjacent motif (PAM). For Type IV CRISPR-Cas systems, the PAM is located at the 5' end on the non-target strand and at the 3' end of the target strand (see below, as an example).

```
5'-NNNNNNNNNNNNNNNNNNNN-3' RNA Spacer (SEQ ID NO: 36)
   | |||||  | ||||||||||||
3'AAANNNNNNNNNNNNNNNNNNNN-5' Target strand (SEQ ID NO: 37)
   ||||
5'TTTNNNNNNNNNNNNNNNNNNNN-3' Non-target strand (SEQ ID NO: 38)
``` in the 3' region (i.e., seed region) of, for example, a 20 nucleotide spacer sequence may be 100% complementary to the target DNA, while the remaining nucleotides in the 5' region of the spacer sequence are substantially complementary (e.g., at least about 70% complementary) to the target DNA. In some embodiments, the first 1 to 10 nucleotides (e.g., the first 1, 2, 3, 4, 5, 6, 7, 8, 9, 10 nucleotides, and any range therein) of the 3' end of the spacer sequence may be 100% complementary to the target DNA, while the remaining nucleotides in the 5' region of the spacer sequence are substantially complementary (e.g., at least about 50% complementary (e.g., at least about 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more or any range or value therein)) to the target DNA.

In some embodiments, a seed region of a spacer may be about 8 to about 10 nucleotides in length, about 5 to about 6 nucleotides in length, or about 6 nucleotides in length.

The term "tracrRNA" refers to a small trans-encoded RNA. TracrRNA is complementary to and base pairs with crRNA to form a crRNA/tracrRNA hybrid, capable of recruiting CRISPR endonucleases and/or CRISPR-associated effectors to target sequences.

As used herein, a "target nucleic acid", "target DNA, "target, RNA," "target nucleotide sequence," "target region," or a "target region in the genome" refers to a region of a plant's genome that is fully complementary (100% complementary) or substantially complementary (e.g., at least 70% complementary (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a spacer sequence in a guide nucleic acid of this invention. A target region useful for a CRISPR-Cas system may be located immediately 3' (e.g., Type V CRISPR-Cas system) or immediately 5' (e.g., Type II CRISPR-Cas system) to a PAM sequence in the genome of the organism (e.g., a plant genome). A target region may be selected from any region of at least 15 consecutive nucleotides (e.g., 16, 17, 18, 19, 20, 21, 22, 23, 24, 25, 26, 27, 28, 29, 30 nucleotides, and the like) located immediately adjacent to a PAM sequence. In some embodiments, the target nucleic acid sequence is an RNA target sequence. In some embodiments, the target nucleic acid sequence is a DNA target sequence.

A "protospacer sequence" refers to the target double stranded DNA and specifically to the portion of the target DNA (e.g., or target region in the genome) that is fully or In the case of Type II CRISPR-Cas (e.g., Cas9) systems, the PAM is located immediately 3' of the target region. The PAM for Type I CRISPR-Cas systems is located 5' of the target strand. There is no known PAM for Type III CRISPR-Cas systems. Makarova et al. describes the nomenclature for all the classes, types and subtypes of CRISPR systems (*Nature Reviews Microbiology* 13:722-736 (2015)). Guide structures and PAMs are described in by R. Barrangou (*Genome Biol.* 16:247 (2015)).

Canonical Cas12a PAMs are T rich. In some embodiments, a canonical Cas12a PAM sequence may be 5'-TTN, 5'-TTTN, or 5'-TTTV. In some embodiments, canonical Cas9 (e.g., *S. pyogenes*) PAMs may be 5'-NGG-3'. In some embodiments, non-canonical PAMs may be used but may be less efficient.

Additional PAM sequences may be determined by those skilled in the art through established experimental and computational approaches. Thus, for example, experimental approaches include targeting a sequence flanked by all possible nucleotide sequences and identifying sequence members that do not undergo targeting, such as through the transformation of target plasmid DNA (Esvelt et al. 2013. *Nat. Methods* 10:1116-1121; Jiang et al. 2013. *Nat. Biotechnol.* 31:233-239). In some aspects, a computational approach can include performing BLAST searches of natural spacers to identify the original target DNA sequences in bacteriophages or plasmids and aligning these sequences to determine conserved sequences adjacent to the target sequence (Briner and Barrangou. 2014. *Appl. Environ. Microbiol.* 80:994-1001; Mojica et al. 2009. *Microbiology* 155:733-740).

In some embodiments, the present invention provides expression cassettes and/or vectors comprising the nucleic acid constructs of the invention (e.g, one or more components of an editing system of the invention). In some embodiments, expression cassettes and/or vectors comprising the nucleic acid constructs of the invention and/or one or more guide nucleic acids may be provided. In some embodiments, a nucleic acid construct of the invention encoding a base editor (e.g., a construct comprising a CRISPR-Cas effector protein and a deaminase domain (e.g., a fusion protein)) or the components for base editing (e.g., a CRISPR-Cas effector protein fused to a peptide tag or an affinity polypeptide, a deaminase domain fused to a peptide tag or an affinity polypeptide, and/or a UGI fused to a peptide tag or an affinity polypeptide), may be comprised on the same or on a separate expression cassette or vector from that comprising the one or more guide nucleic acids. When the nucleic acid construct encoding a base editor or the components for base editing is/are comprised on separate expression cassette(s) or vector(s) from that comprising the guide nucleic acid, a target nucleic acid may be contacted with (e.g., provided with) the expression cassette(s) or vector(s) encoding the base editor or components for base editing in any order from one another and the guide nucleic acid, e.g., prior to, concurrently with, or after the expression cassette comprising the guide nucleic acid is provided (e.g., contacted with the target nucleic acid).

Fusion proteins of the invention may comprise sequence-specific DNA binding domains, CRISPR-Cas polypeptides, and/or deaminase domains fused to peptide tags or affinity polypeptides that interact with the peptide tags, as known in the art, for use in recruiting the deaminase to the target nucleic acid. Methods of recruiting may also comprise guide nucleic acids linked to RNA recruiting motifs and deaminases fused to affinity polypeptides capable of interacting with RNA recruiting motifs, thereby recruiting the deaminase to the target nucleic acid. Alternatively, chemical interactions may be used to recruit polypeptides (e.g., deaminases) to a target nucleic acid.

A peptide tag (e.g., epitope) useful with this invention may include, but is not limited to, a GCN4 peptide tag (e.g., Sun-Tag), a c-Myc affinity tag, an HA affinity tag, a His affinity tag, an S affinity tag, a methionine-His affinity tag, an RGD-His affinity tag, a FLAG octapeptide, a strep tag or strep tag II, a V5 tag, and/or a VSV-G epitope. Any epitope that may be linked to a polypeptide and for which there is a corresponding affinity polypeptide that may be linked to another polypeptide may be used with this invention as a peptide tag. In some embodiments, a peptide tag may comprise 1 or 2 or more copies of a peptide tag (e.g., repeat unit, multimerized epitope (e.g., tandem repeats)) (e.g., 1, 2, 3, 4, 5, 6, 7, 8, 9, 10, 11, 12, 13, 14, 15, 16, 17, 18, 19, 20, 21, 22, 23, 24, 25 or more repeat units. In some embodiments, an affinity polypeptide that interacts with/binds to a peptide tag may be an antibody. In some embodiments, the antibody may be a scFv antibody. In some embodiments, an affinity polypeptide that binds to a peptide tag may be synthetic (e.g., evolved for affinity interaction) including, but not limited to, an affibody, an anticalin, a monobody and/or a DARPin (see, e.g., Sha et al., *Protein Sci.* 26 (5): 910-924 (2017)); Gilbreth (*Curr Opin Struc Biol* 22 (4): 413-420 (2013)), U.S. Pat. No. 9,982,053, each of which are incorporated by reference in their entireties for the teachings relevant to affibodies, anticalins, monobodies and/or DARPins. Example peptide tags include but are not limited to SEQ ID NOs: 39-41.

In some embodiments, a guide nucleic acid may be linked to an RNA recruiting motif, and a polypeptide to be recruited (e.g., a deaminase) may be fused to an affinity polypeptide that binds to the RNA recruiting motif, wherein the guide binds to the target nucleic acid and the RNA recruiting motif binds to the affinity polypeptide, thereby recruiting the polypeptide to the guide and contacting the target nucleic acid with the polypeptide (e.g., deaminase). In some embodiments, two or more polypeptides may be recruited to a guide nucleic acid, thereby contacting the target nucleic acid with two or more polypeptides (e.g., deaminases).

In some embodiments, a polypeptide fused to an affinity polypeptide may be a reverse transcriptase and the guide nucleic acid may be an extended guide nucleic acid linked to an RNA recruiting motif. In some embodiments, an RNA recruiting motif may be located on the 3' end of the extended portion of an extended guide nucleic acid (e.g., 5'-3', repeat-spacer-extended portion (RT template-primer binding site)-RNA recruiting motif). In some embodiments, an RNA recruiting motif may be embedded in the extended portion.

In some embodiments of the invention, an extended guide RNA and/or guide RNA may be linked to one or to two or more RNA recruiting motifs (e.g., 1, 2, 3, 4, 5, 6, 7, 8, 9, 10 or more motifs; e.g., at least 10 to about 25 motifs), optionally wherein the two or more RNA recruiting motifs may be the same RNA recruiting motif or different RNA recruiting motifs. In some embodiments, an RNA recruiting motif and corresponding affinity polypeptide may include, but is not limited to, a telomerase Ku binding motif (e.g., Ku binding hairpin) and the corresponding affinity polypeptide Ku (e.g., Ku heterodimer), a telomerase Sm7 binding motif and the corresponding affinity polypeptide Sm7, an MS2 phage operator stem-loop and the corresponding affinity polypeptide MS2 Coat Protein (MCP), a PP7 phage operator stem-loop and the corresponding affinity polypeptide PP7 Coat Protein (PCP), an SfMu phage Com stem-loop and the corresponding affinity polypeptide Com RNA binding protein, a PUF binding site (PBS) and the affinity polypeptide *Pumilio*/fem-3 mRNA binding factor (PUF), and/or a synthetic RNA-aptamer and the aptamer ligand as the corresponding affinity polypeptide. In some embodiments, the RNA recruiting motif and corresponding affinity polypeptide may be an MS2 phage operator stem-loop and the affinity polypeptide MS2 Coat Protein (MCP). In some embodiments, the RNA recruiting motif and corresponding affinity polypeptide may be a PUF binding site (PBS) and the affinity polypeptide *Pumilio*/fem-3 mRNA binding factor (PUF). Example recruiting motifs include but are not limited to SEQ ID NOs: 42-52.

In some embodiments, the components for recruiting polypeptides and nucleic acids may those that function through chemical interactions that may include, but are not limited to, rapamycin-inducible dimerization of FRB-FKBP; Biotin-streptavidin; SNAP tag; Halo tag; CLIP tag; DmrA-DmrC heterodimer induced by a compound; bifunctional ligand (e.g., fusion of two protein-binding chemicals together; e.g. dihyrofolate reductase (DHFR).

In some embodiments, the nucleic acid constructs, expression cassettes or vectors of the invention that are optimized for expression in a plant may be about 70% to 100% identical (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to the nucleic acid constructs, expression cassettes or vectors comprising the same polynucleotide(s) but which have not been codon optimized for expression in a plant.

Further provided herein are cells comprising one or more polynucleotides, guide nucleic acids, nucleic acid constructs, expression cassettes or vectors of the invention.

The invention will now be described with reference to the following examples. It should be appreciated that these examples are not intended to limit the scope of the claims to the invention, but are rather intended to be exemplary of certain embodiments. Any variations in the exemplified methods that occur to the skilled artisan are intended to fall within the scope of the invention.

EXAMPLES

The following examples are given for the purpose of illustrating various embodiments of the disclosure and are not meant to limit the present disclosure in any fashion. Changes therein and other uses which are encompassed within the spirit of the disclosure, as defined by the scope of the claims, will occur to those skilled in the art.

Example 1. Identification of Myrosinases and MYB Transcription Factors in *B. juncea*

The genome assembly version v1.5 and gene annotation of *Brassica juncea* was downloaded from *Brassica* Database (BRAD, brassicadb.org/brad/) and utilized for genomic analyses. In addition, *Arabidopsis thaliana* genome (assembly version TAIR10) from Phytozome Database and the genomic progenitors of *B. juncea-Brassica rapa* and *Brassica nigra*—from BRAD were used for comparative analyses.

First, we conducted ortholog inference of myrosinase, AOP2, and CYP79F1 in *B. juncea* using a gene family phylogenetics analysis, which utilized the predicted gene models from the respective genome annotations. We queried the species' proteomes-based on predicted gene models in the genome annotations—with the protein-coding sequences from the *A. thaliana* gene identifiers from Table 1 using Blast (blastp Version 2.5.0; parameters: '-seg no-max_hsps 1 -max_target_seqs 40 -use_sw_tback') and extracted protein sequence Blast hits with passing the E value <1e-10 cutoff. A second iteration of the Blast search was performed using the all passing Blast hits as query sequences, in order to generate reciprocal E value scores, which were used in clustering. Clustering was performed with the program hcluster_sg (Li H. Constructing the TreeFam database. PhD thesis, Chinese Academy of Sciences Beijing. 2006; Ver. 0.5.1, parameters: "-m 750-w 0-s 0.34"). Sequences were aligned using the multiple sequence alignment program T-Coffee with default parameter settings (Notredame et al . . . 2000. T-Coffee: A novel method for multiple sequence alignments. *JMB,* 302 (205-217); Version_11.00.8cbe486). For phylogenetic tree reconstruction, we used ModelFinder for substitution model selection (Kalyaanamoorthy et al. (2017) ModelFinder: Fast model selection for accurate phylogenetic estimates. *Nat. Methods,* 14:587-589) and IQ-Tree for tree inference and branch support estimation with ultrafast bootstrap approximation (Hoang et al. (2018) UFBoot2: Improving the ultrafast bootstrap approximation. *Mol. Biol. Evol.,* 35:518-522, Nguyen et al. Mol. Biol. Evol., 32:268-274 (2015); *IQ-Tree Version* 1.5.5; parameters: "-bb 1000") using DNA coding sequences after back translation with the tranalign software tool from the EMBOSS package (Rice et al. *EMBOSS: The European Molecular Biology Open Software Suite.* (2000). Trends in Genetics 16, (6) pp276-277; Ver. 6.6.0.0). Orthologs of AOP2 and CYP79F1 were found by examining the tree topology and identification gene clustering from multiple species for which the most common ancestor node is a speciation event. However, this analysis did not identify orthologs from myrosinase genes in *B. juncea*. This analysis relies on predicted gene models in the genome annotation, any unannotated genes would be undiscoverable. Given this limitation, a Blast search was conducted on the whole genome assembly with the myrosinase gene IDs from Table 1. Blast search results were filtered to retain sequence hits at least 70% query coverage and E value <1e-10. Phylogenetic analysis was then performed in Geneious® (Version 2020.1.2) using Clustal Omega (Sievers & Higgins (2018) Clustal Omega for making accurate alignments of many protein sciences. *Protein Sci* 27:135-145) for sequence alignment and neighbor joining methodology for tree inference. Orthologs of myrosinase were found by examining the tree topology and identification gene clustering from multiple species for which the most common ancestor node is a speciation event. Manual annotation of the resulting genes was performed using visual examination of NGS short read and long read alignments to the genome assembly (NCBI datasets: SRP064721, SRP137085, SRP041526). Gene sequence polishing was done using visual examination of next generation short (NGS) short read alignments to the genome assembly (NCBI datasets: SRP058895).

TABLE 1

Gene IDs used for queries

| Gene Name | Arabidopsis Gene ID | *Brassica rapa* gene ID | *Brassica nigra* gene ID |
| --- | --- | --- | --- |
| TGG1/ Myrosinase | AT5G26000 | Bra020523, Bra020549, Bra032343 | BniB006711, BniB006713, BniB009758, BniB014275 |
| AOP2 | AT4G03050 | Bra034180 | BniB044970, BniB042223 |
| CYP79F1 | AT1G16410 | Bra026058 | BniB043181 |

Example 2. Gene-Editing of Plants

Disarmed *Agrobacterium tumefaciens* was used to introduce a T-DNA cassette expressing a selectable marker and CRISPR Cas gene editing components targeted to create double-strand breaks in myrosinase, AOP2 or CYP79F1 gene coding sequences. The T-DNA further expressed crRNAs programmed to target *Brassica juncea* (L.) myrosinase, AOP2 or CYP79F1 enzyme coding genes. PCR and next generation sequencing were used to confirm that intended genetic changes were achieved. Genomic DNA was isolated from leaf tissue and used as a template in PCR reactions using primers specific to the genes targeted. The amplified products were subsequently sequenced and characterized to confirm the genetic changes. Events of interest were advanced and progeny selected from the segregating population. SEQ ID NOs: 141-599 provide some examples of mutations achieved using the editing systems as described herein. Table 2 (see end of Examples) provides each of the example edits along with plant identification no (CEID), the relevant edited locus, the cultivar, and the allele edit percent. SEQ ID NOs: 679-741 are the cultivar wild-type genomic (cDNA) sequences for each locus. As can be seen a wide variety of edits were achieved. The plants comprising the mutations/edits provided in Table 2 (end of Examples) are non-pungent or reduced in pungency. Table 5 (end of Examples) provides the wild type sequence for each targeted locus in the *Brassica juncea* varieties of Green Wave, Red Giant and Southern Giant Curl.

Myrosinase Path

Lead E0 candidate events were first identified by cross comparative taste evaluations to wild-type and other edited E0 material. Lead E0 candidates were characterized by a consensus non-pungent taste assessment call across a total of three researchers. These edited events were subsequently vegetatively propagated and evaluated at a later date with a quantitative myrosinase activity assay via the measurement of glucose release as a result of hydrolysis of exogenously supplied sinigrin to leaf extracts. Seeds were harvested from the lead E0 events and a large E1 progeny screening was deployed to assess the heritability of the trait and to aid in the association of underlying loci to the biochemical evaluation of the trait. E1 progeny were sampled at multiple time points for cross-comparative assessments of glucose release activity to identify candidates to continue forward on a product development path.

AOP2 Path

Lead non pungent E0 events (CE35423 and CE34664) were identified by cross comparative taste evaluations to wild-type and other edited material. In a subsequent composition analysis, leaf material was harvested from the lead event, lyophilized and evaluated with HPLC for determination of glucosinolate composition. In accordance with the observation of non-pungency of the plant material upon consumption of fresh tissue, a reduction of sinigrin concentration was observed in comparison to other edited plants exhibiting mild pungency and wild-type plant material (Table 3). Accordingly, sinigrin is the glucosinolate precursor to the pungent breakdown product of allyl isothiocyanate subsequent to the hydrolysis by myrosinase enzymes; supporting the sensory observation of reduced pungency in CE35423 and CE34664.

TABLE 3

Comparison of sinigrin concentration and pungency of edited and wild type plants

| CE-ID | Taste | Average Sinigrin (mg/g) |
|---|---|---|
| CE34664 | non-pungent | 1.1 |
| CE35422 | mild pungent | 13.18 |
| CE35423 | non-pungent | 2.91 |
| CE36443 | mild pungent | 11.98 |
| WT | pungent | 18.95 |

Example 3. Functional Analysis of Edited Plants

Figure 7:
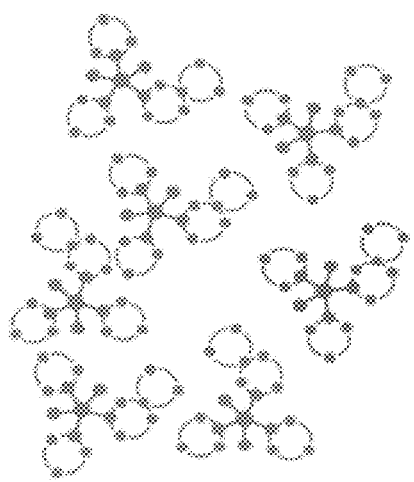
FIG. 7 provides a cartoon of an example strategy for reducing the pungency in a plant through myrosinase knockout. As shown, the end products may be used as a measure of the reduction in myrosinase activity and the reduction in pungency.
Figure 7:
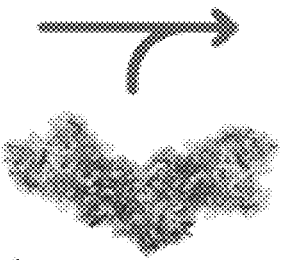
Figure 7:
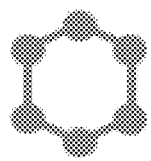
Figure 7:
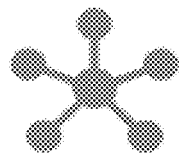
Figure 7:
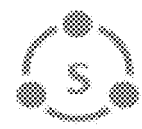
Figure 8:
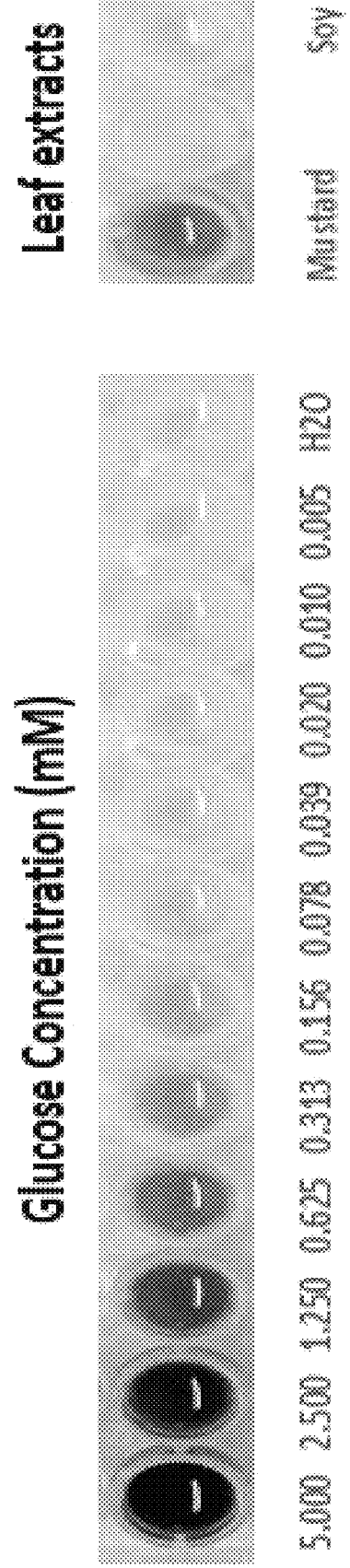
FIG. 8 illustrates colorimetric detection of myrosinase activity via detection of glucose. Range of glucose detection was prepared by evaluating a standard curve of various glucose concentrations. Leaf material (mustard) naturally containing myrosinase/glucosinolate reaction system (mustard) are compared with leaf material (soy) which lacks the reaction capabilities.
Figure 9:
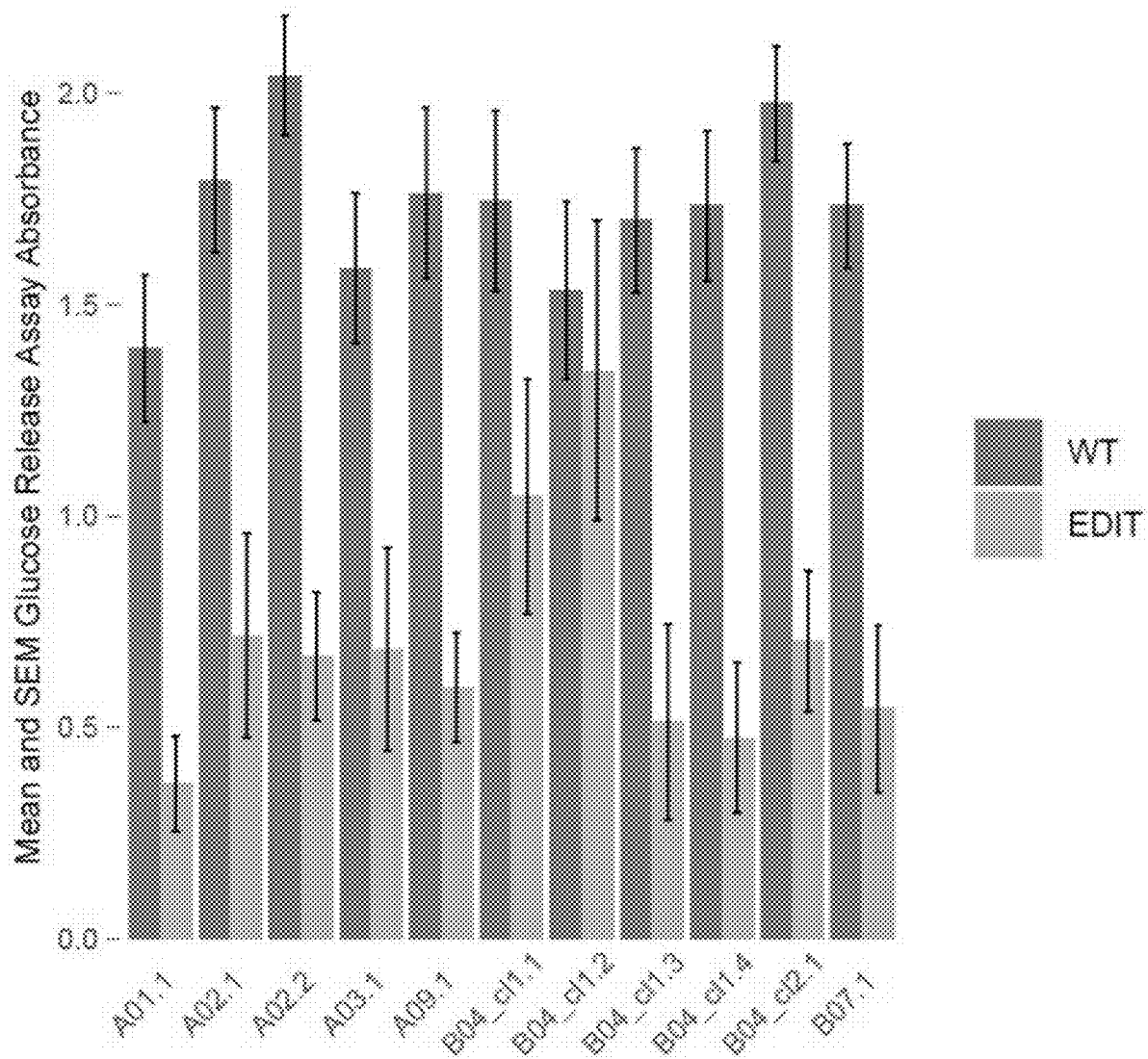
FIG. 9 shows the glucose release assay absorbance (mean and standard error of the mean) (SEM)) for 11 edited myrosinase genes versus reference wild-type genes.
Figure 10:
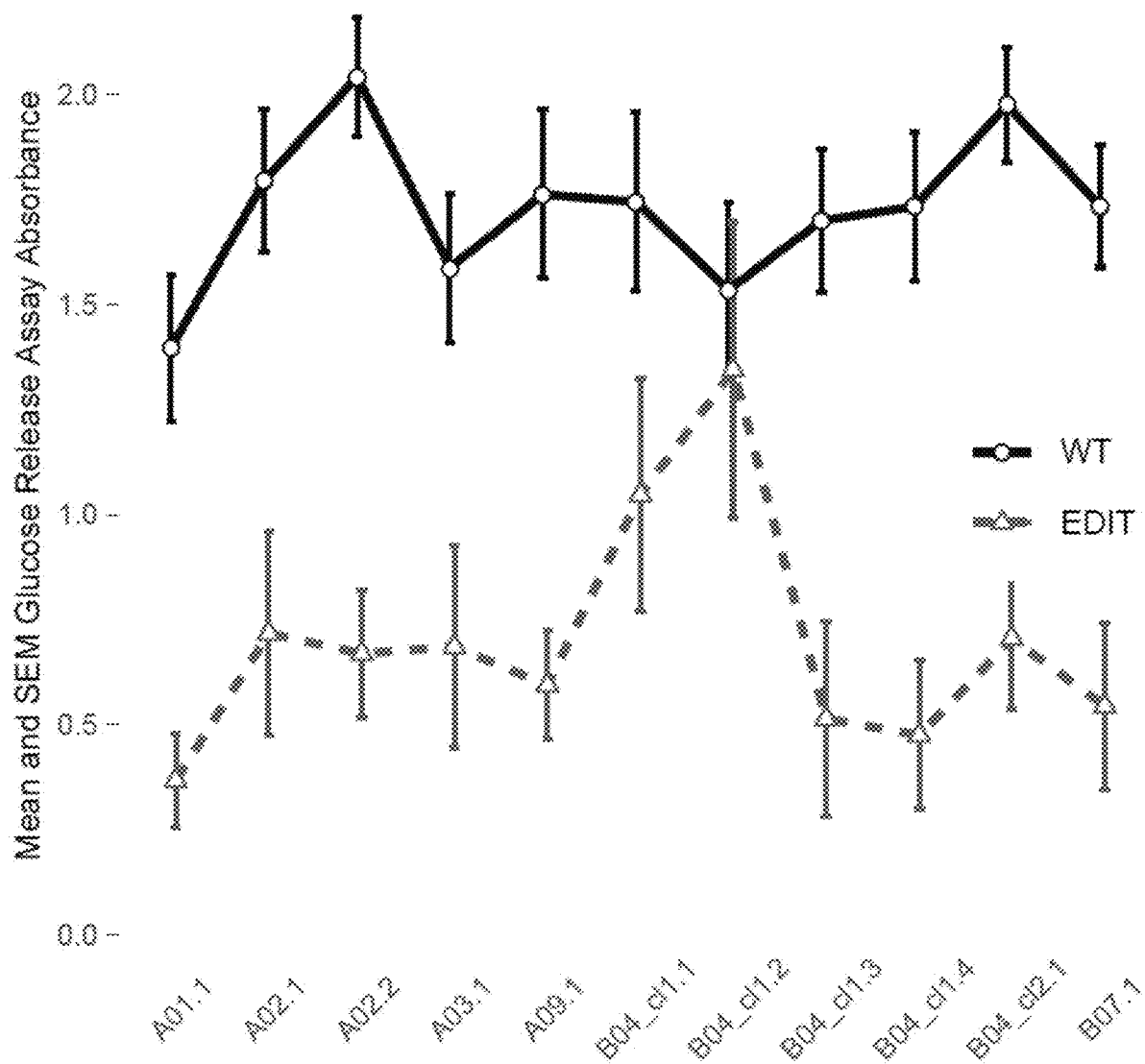
FIG. 10 provides the same information as FIG. 9 in a different format.

Glucose is released as a product of the hydrolysis reaction of myrosinase with glucosinolate substrate. A relatively simple assay can be used to quantify the emittance of glucose as a rapid indicator of myrosinase activity as reported by Dosz et al., *J Agric Food Chem.* 62 (32): 8094-100 (2014)). As a control, myrosinase activity was tested via colorimetric detection of glucose as shown in FIG. 7 and FIG. 8. A range of glucose detection was prepared by evaluating a standard curve of various glucose concentrations. To demonstrate that released glucose was resultant from an endogenous myrosinase/glucosinolate reaction system, leaf material (mustard) naturally containing the enzymatic system were compared with leaf material (soy) which lacks the reaction capabilities.

Once the transformed plants were confirmed with intended disruption of myrosinases to reduce pungency and/or reduced bitterness in mustard greens, the colorimetric detection assay was used for cross-comparative analyses to characterize events of interest in relation to their levels of detectable myrosinase activities. Additional plant species may be pursued with similar in planta editing strategies to alter flavor/odor profiles in desirable consumer crops of interest (i.e. radish, broccoli, cauliflower, and *papaya*). This approach can be a rapid path for gathering additional functional evidence to extend this opportunity beyond mustard greens.

Table 4 (see, end of Examples) provides the phenotypic data (glucose release assay) for the edited plants and the results of the glucose release assay in the wild type.

Example 4. Glucosinolate profiles of edited plants

Glucosinolate profiles were completed by extraction of glucosinolates followed by HPLC analysis. Glucosinolates were extracted from fresh tissue that had been fully dried by lyophilization. For each sample about 1-10 g of tissue was lyophilized. The lyophilized tissue was ground into a fine, uniform powder and 0.1 g was weighed out for each sample. To the 0.1 g of ground lyophilized tissue, 25 ml of boiling water was added and the mixture was boiled for 10 minutes before incubating at 70° C. for 4 hours. The samples were then centrifuged, and the remaining supernatant was then subjected to HPLC analysis. Table 3 provides phenotypic data (sinigrin content) for plants edited at the AOP2 locus and a wild-type control of the same cultivar.

Example 5. Statistical modeling for the association of edited myrosinase loci and corresponding effects on glucosinolate metabolism in leaf tissues The molecular data for each myrosinase locus and E0 generation plant was summarized to a label of "Edit" when for any guide spacer alignment regions within the locus for a plant had over 5% non-wild type read alignments. A label of "WT" (Wildtype) was given to all loci within E0 plants that did not meet the stated requirement but had over 100 reads that mapped to at least one of the spacer alignment regions within a locus. A label of "Insufficient Reads" was applied to all loci within a plant that did not have at least 100 reads that mapped to at least one of the spacer alignment regions within the locus.

The summarized call for each locus for an E0 plant was then paired with the associated quantitative glucose release assay absorbance value (GRA) measured on leaf sample collected from the same E0 plant. Lower GRA values are validated to be associated with lower myrosinase expression in the plant. Therefore, if a molecularly edited myrosinase locus is associated with lower GRA values, it can be inferred that the edited locus is also associated with less myrosinase activity in the plant.

In this study, all data that had a label of "Insufficient Reads" were removed from the analysis. The final data set consisted of between 23 and 31 datapoints for 11 loci (A01.1, A02.1, A02.2, A03.1, A09.1, B04_cl1.1, B04_cl1.2, B04_cl1.3, B04_cl1.4, B04_cl2.1, B07.1) from a set of 27 unique edited E0 plants and 2 replicates of unedited Red Giant and Southern Giant Curled control material. The mean and standard error of the GRA score was computed for each locus. A 2-sample t-test was conducted for each locus and a Hochberg multiple testing correction was utilized since it is valid for non-negatively associated tests Each of the 11 loci were positively correlated with functional myrosinase activity in leaf tissue as quantitatively assessed by the hydrolysis of exogenously supplied sinigrin.

TABLE 2

Edited Plants

| PLANT | GENE | LOCUS | CULTIVAR | EDITED SEQ ID NO | ALLELE EDIT PERCENTAGE |
|---|---|---|---|---|---|
| CE15785_S25 | Myrosinase | A09.1 | Red Giant | 141 | 0.5 |
| CE15785_S25 | Myrosinase | A09.1 | Red Giant | 142 | 1.94 |
| CE15785_S25 | Myrosinase | A09.1 | Red Giant | 143 | 0.54 |
| CE15785_S25 | Myrosinase | A09.1 | Red Giant | 144 | 2.19 |
| CE15785_S25 | Myrosinase | A09.1 | Red Giant | 145 | 3.73 |
| CE15785_S25 | Myrosinase | A09.1 | Red Giant | 146 | 6.54 |
| CE15785_S25 | Myrosinase | A09.1 | Red Giant | 147 | 65.53 |
| CE15785_S654 | Myrosinase | A01.1 | Red Giant | 148 | 100 |
| CE15785_S654 | Myrosinase | A02.1 | Red Giant | 149 | 99.05 |
| CE15785_S654 | Myrosinase | A02.1 | Red Giant | 150 | 100 |
| CE15785_S654 | Myrosinase | A03.1 | Red Giant | 151 | 100 |
| CE15785_S654 | Myrosinase | A03.1 | Red Giant | 152 | 100 |
| CE15785_S654 | Myrosinase | A09.1 | Red Giant | 153 | 99.77 |
| CE15785_S654 | Myrosinase | B04_cl1.4 | Red Giant | 154 | 100 |
| CE15785_S654 | Myrosinase | B07.1 | Red Giant | 155 | 100 |
| CE18322_S678 | Myrosinase | A01.1 | Red Giant | 156 | 76.23 |
| CE18322_S678 | Myrosinase | A02.1 | Red Giant | 157 | 99.27 |
| CE18322_S678 | Myrosinase | A02.1 | Red Giant | 158 | 36.63 |
| CE18322_S678 | Myrosinase | A02.1 | Red Giant | 159 | 62.67 |
| CE18322_S678 | Myrosinase | A02.2 | Red Giant | 160 | 99.87 |
| CE18322_S678 | Myrosinase | A03.1 | Red Giant | 161 | 52.53 |
| CE18322_S678 | Myrosinase | A03.1 | Red Giant | 162 | 42.46 |
| CE18322_S678 | Myrosinase | A09.1 | Red Giant | 163 | 100 |
| CE18322_S678 | Myrosinase | A09.1 | Red Giant | 164 | 98.16 |
| CE18322_S678 | Myrosinase | B04_cl1.2 | Red Giant | 165 | 100 |
| CE18322_S678 | Myrosinase | B04_cl1.3 | Red Giant | 166 | 99.2 |
| CE18322_S678 | Myrosinase | B04_cl1.4 | Red Giant | 167 | 58.11 |
| CE18322_S678 | Myrosinase | B04_cl1.4 | Red Giant | 168 | 39.97 |
| CE18322_S678 | Myrosinase | B04_cl2.1 | Red Giant | 169 | 55.6 |
| CE18322_S678 | Myrosinase | B04_cl2.1 | Red Giant | 170 | 39.83 |
| CE18322_S678 | Myrosinase | B04_cl2.1 | Red Giant | 171 | 57 |
| CE18322_S678 | Myrosinase | B04_cl2.1 | Red Giant | 172 | 42.41 |
| CE18322_S678 | Myrosinase | B07.1 | Red Giant | 173 | 51.28 |
| CE18322_S678 | Myrosinase | B07.1 | Red Giant | 174 | 48.05 |
| CE18322_S678 | Myrosinase | B07.1 | Red Giant | 175 | 99.96 |
| CE21573_S2 | Myrosinase | A02.1 | Southern Giant Curl | 176 | 42.71 |
| CE21573_S2 | Myrosinase | A02.2 | Southern Giant Curl | 177 | 48.33 |
| CE21573_S2 | Myrosinase | A02.2 | Southern Giant Curl | 178 | 47.58 |
| CE21573_S2 | Myrosinase | A09.1 | Southern Giant Curl | 179 | 44.73 |
| CE21573_S2 | Myrosinase | B04_cl1.1 | Southern Giant Curl | 180 | 38.12 |
| CE21573_S2 | Myrosinase | B04_cl2.1 | Southern Giant Curl | 181 | 21.44 |
| CE21573_S2 | Myrosinase | B07.1 | Southern Giant Curl | 182 | 12.2 |
| CE21573_S36 | Myrosinase | A02.2 | Southern Giant Curl | 183 | 34.94 |
| CE21573_S36 | Myrosinase | A02.2 | Southern Giant Curl | 184 | 42.66 |
| CE21573_S36 | Myrosinase | A09.1 | Southern Giant Curl | 185 | 4.96 |
| CE21573_S36 | Myrosinase | A09.1 | Southern Giant Curl | 186 | 28.46 |
| CE21573_S612 | Myrosinase | A02.1 | Southern Giant Curl | 187 | 50.13 |
| CE21573_S612 | Myrosinase | A02.2 | Southern Giant Curl | 188 | 46.39 |
| CE21573_S612 | Myrosinase | A02.2 | Southern Giant Curl | 189 | 46.39 |
| CE21573_S612 | Myrosinase | A09.1 | Southern Giant Curl | 190 | 47.29 |
| CE21573_S612 | Myrosinase | B04_cl1.1 | Southern Giant Curl | 191 | 34.81 |
| CE21573_S612 | Myrosinase | B04_cl2.1 | Southern Giant Curl | 192 | 21.21 |
| CE31357_S57 | Myrosinase | A02.1 | Southern Giant Curl | 193 | 4.41 |
| CE31357_S57 | Myrosinase | A02.2 | Southern Giant Curl | 194 | 95.72 |

TABLE 2-continued

Edited Plants

| PLANT | GENE | LOCUS | CULTIVAR | EDITED SEQ ID NO | ALLELE EDIT PERCENTAGE |
|---|---|---|---|---|---|
| CE31357_S57 | Myrosinase | A02.2 | Southern Giant Curl | 195 | 93.26 |
| CE31357_S57 | Myrosinase | A03.1 | Southern Giant Curl | 196 | 47.63 |
| CE31357_S57 | Myrosinase | A03.1 | Southern Giant Curl | 197 | 0.55 |
| CE31357_S57 | Myrosinase | A03.1 | Southern Giant Curl | 198 | 49.14 |
| CE31357_S57 | Myrosinase | A03.1 | Southern Giant Curl | 199 | 45.56 |
| CE31357_S57 | Myrosinase | A09.1 | Southern Giant Curl | 200 | 0.77 |
| CE31357_S57 | Myrosinase | B04_cl1.3 | Southern Giant Curl | 201 | 22.94 |
| CE31357_S57 | Myrosinase | B04_cl1.4 | Southern Giant Curl | 202 | 50.35 |
| CE31357_S57 | Myrosinase | B04_cl1.4 | Southern Giant Curl | 203 | 45.42 |
| CE31357_S57 | Myrosinase | B04_cl2.1 | Southern Giant Curl | 204 | 39.78 |
| CE31357_S57 | Myrosinase | B04_cl2.1 | Southern Giant Curl | 205 | 100 |
| CE31357_S57 | Myrosinase | B07.1 | Southern Giant Curl | 206 | 37.32 |
| CE31357_S667 | Myrosinase | A02.2 | Southern Giant Curl | 207 | 99.44 |
| CE31357_S667 | Myrosinase | A02.2 | Southern Giant Curl | 208 | 97.99 |
| CE31357_S667 | Myrosinase | A03.1 | Southern Giant Curl | 209 | 51.99 |
| CE31357_S667 | Myrosinase | A03.1 | Southern Giant Curl | 210 | 51.48 |
| CE31357_S667 | Myrosinase | A03.1 | Southern Giant Curl | 211 | 46.41 |
| CE31357_S667 | Myrosinase | B04_cl1.3 | Southern Giant Curl | 212 | 25.32 |
| CE31357_S667 | Myrosinase | B04_cl1.4 | Southern Giant Curl | 213 | 48.57 |
| CE31357_S667 | Myrosinase | B04_cl1.4 | Southern Giant Curl | 214 | 45 |
| CE31357_S667 | Myrosinase | B04_cl2.1 | Southern Giant Curl | 215 | 46.28 |
| CE31357_S667 | Myrosinase | B04_cl2.1 | Southern Giant Curl | 216 | 99.86 |
| CE31357_S667 | Myrosinase | B07.1 | Southern Giant Curl | 217 | 19.96 |
| CE33147_S58 | Myrosinase | A01.1 | Red Giant | 218 | 98.02 |
| CE33147_S58 | Myrosinase | A02.1 | Red Giant | 219 | 97.42 |
| CE33147_S58 | Myrosinase | A02.1 | Red Giant | 220 | 99.51 |
| CE33147_S58 | Myrosinase | A03.1 | Red Giant | 221 | 92.64 |
| CE33147_S58 | Myrosinase | A03.1 | Red Giant | 222 | 96.88 |
| CE33147_S58 | Myrosinase | A09.1 | Red Giant | 223 | 80.7 |
| CE33147_S58 | Myrosinase | B04_cl1.3 | Red Giant | 224 | 99.71 |
| CE33147_S58 | Myrosinase | B04_cl1.4 | Red Giant | 225 | 99.79 |
| CE33147_S58 | Myrosinase | B04_cl2.1 | Red Giant | 226 | 92.2 |
| CE33147_S58 | Myrosinase | B07.1 | Red Giant | 227 | 97.36 |
| CE33147_S668 | Myrosinase | A01.1 | Red Giant | 228 | 99.75 |
| CE33147_S668 | Myrosinase | A02.1 | Red Giant | 229 | 99.45 |
| CE33147_S668 | Myrosinase | A02.1 | Red Giant | 230 | 99.72 |
| CE33147_S668 | Myrosinase | A03.1 | Red Giant | 231 | 99.36 |
| CE33147_S668 | Myrosinase | A03.1 | Red Giant | 232 | 99.46 |
| CE33147_S668 | Myrosinase | A09.1 | Red Giant | 233 | 78.46 |
| CE33147_S668 | Myrosinase | B04_cl1.3 | Red Giant | 234 | 99.12 |
| CE33147_S668 | Myrosinase | B04_cl1.4 | Red Giant | 235 | 99.57 |
| CE33147_S668 | Myrosinase | B07.1 | Red Giant | 236 | 99.05 |
| CE33150_S3 | Myrosinase | A02.2 | Red Giant | 237 | 99.13 |
| CE33150_S3 | Myrosinase | A02.2 | Red Giant | 238 | 98.94 |
| CE33150_S3 | Myrosinase | A03.1 | Red Giant | 239 | 50.25 |
| CE33150_S3 | Myrosinase | A09.1 | Red Giant | 240 | 55.11 |
| CE33150_S3 | Myrosinase | A09.1 | Red Giant | 241 | 54.09 |
| CE33150_S3 | Myrosinase | B04_cl1.4 | Red Giant | 242 | 99.42 |
| CE33150_S3 | Myrosinase | B04_cl2.1 | Red Giant | 243 | 45.07 |
| CE33150_S3 | Myrosinase | B04_cl2.1 | Red Giant | 244 | 98.65 |
| CE33150_S3 | Myrosinase | B07.1 | Red Giant | 245 | 50.7 |

TABLE 2-continued

Edited Plants

| PLANT | GENE | LOCUS | CULTIVAR | EDITED SEQ ID NO | ALLELE EDIT PERCENTAGE |
|---|---|---|---|---|---|
| CE33150_S3 | Myrosinase | B07.1 | Red Giant | 246 | 50.81 |
| CE33150_S3 | Myrosinase | B07.1 | Red Giant | 247 | 47.25 |
| CE33150_S613 | Myrosinase | A02.2 | Red Giant | 248 | 99.82 |
| CE33150_S613 | Myrosinase | A02.2 | Red Giant | 249 | 99.65 |
| CE33150_S613 | Myrosinase | A03.1 | Red Giant | 250 | 55.68 |
| CE33150_S613 | Myrosinase | A09.1 | Red Giant | 251 | 53.35 |
| CE33150_S613 | Myrosinase | A09.1 | Red Giant | 252 | 53.53 |
| CE33150_S613 | Myrosinase | B04_cl1.4 | Red Giant | 253 | 98.94 |
| CE33150_S613 | Myrosinase | B04_cl2.1 | Red Giant | 254 | 49.68 |
| CE33150_S613 | Myrosinase | B04_cl2.1 | Red Giant | 255 | 100 |
| CE33150_S613 | Myrosinase | B07.1 | Red Giant | 256 | 50.96 |
| CE33150_S613 | Myrosinase | B07.1 | Red Giant | 257 | 51.23 |
| CE33150_S613 | Myrosinase | B07.1 | Red Giant | 258 | 48.42 |
| CE33152_S11 | Myrosinase | A01.1 | Red Giant | 259 | 49.68 |
| CE33152_S11 | Myrosinase | A02.1 | Red Giant | 260 | 97.61 |
| CE33152_S11 | Myrosinase | A02.1 | Red Giant | 261 | 4.84 |
| CE33152_S11 | Myrosinase | A02.1 | Red Giant | 262 | 48.37 |
| CE33152_S11 | Myrosinase | A02.2 | Red Giant | 263 | 50.16 |
| CE33152_S11 | Myrosinase | A03.1 | Red Giant | 264 | 58.56 |
| CE33152_S11 | Myrosinase | A03.1 | Red Giant | 265 | 35.61 |
| CE33152_S11 | Myrosinase | A09.1 | Red Giant | 266 | 94.48 |
| CE33152_S11 | Myrosinase | A09.1 | Red Giant | 267 | 95.33 |
| CE33152_S11 | Myrosinase | B04_cl1.2 | Red Giant | 268 | 97.8 |
| CE33152_S11 | Myrosinase | B04_cl1.3 | Red Giant | 269 | 97.61 |
| CE33152_S11 | Myrosinase | B04_cl1.4 | Red Giant | 270 | 60.82 |
| CE33152_S11 | Myrosinase | B04_cl1.4 | Red Giant | 271 | 36.24 |
| CE33152_S11 | Myrosinase | B04_cl2.1 | Red Giant | 272 | 26.38 |
| CE33152_S11 | Myrosinase | B04_cl2.1 | Red Giant | 273 | 19.92 |
| CE33152_S11 | Myrosinase | B04_cl2.1 | Red Giant | 274 | 55.09 |
| CE33152_S11 | Myrosinase | B04_cl2.1 | Red Giant | 275 | 44.16 |
| CE33152_S11 | Myrosinase | B07.1 | Red Giant | 276 | 49.24 |
| CE33152_S11 | Myrosinase | B07.1 | Red Giant | 277 | 48.84 |
| CE33152_S11 | Myrosinase | B07.1 | Red Giant | 278 | 98.23 |
| CE33152_S621 | Myrosinase | A01.1 | Red Giant | 279 | 45.03 |
| CE33152_S621 | Myrosinase | A02.1 | Red Giant | 280 | 98.54 |
| CE33152_S621 | Myrosinase | A02.1 | Red Giant | 281 | 6.25 |
| CE33152_S621 | Myrosinase | A02.1 | Red Giant | 282 | 44.95 |
| CE33152_S621 | Myrosinase | A02.2 | Red Giant | 283 | 49.8 |
| CE33152_S621 | Myrosinase | A03.1 | Red Giant | 284 | 57.46 |
| CE33152_S621 | Myrosinase | A03.1 | Red Giant | 285 | 38.9 |
| CE33152_S621 | Myrosinase | A09.1 | Red Giant | 286 | 96.71 |
| CE33152_S621 | Myrosinase | A09.1 | Red Giant | 287 | 99.42 |
| CE33152_S621 | Myrosinase | B04_cl1.2 | Red Giant | 288 | 99.47 |
| CE33152_S621 | Myrosinase | B04_cl1.3 | Red Giant | 289 | 97.82 |
| CE33152_S621 | Myrosinase | B04_cl1.4 | Red Giant | 290 | 58.03 |
| CE33152_S621 | Myrosinase | B04_cl1.4 | Red Giant | 291 | 40.04 |
| CE33152_S621 | Myrosinase | B04_cl2.1 | Red Giant | 292 | 53.68 |
| CE33152_S621 | Myrosinase | B04_cl2.1 | Red Giant | 293 | 22.57 |
| CE33152_S621 | Myrosinase | B04_cl2.1 | Red Giant | 294 | 53.46 |
| CE33152_S621 | Myrosinase | B04_cl2.1 | Red Giant | 295 | 46.21 |
| CE33152_S621 | Myrosinase | B07.1 | Red Giant | 296 | 49.7 |
| CE33152_S621 | Myrosinase | B07.1 | Red Giant | 297 | 49.43 |
| CE33152_S621 | Myrosinase | B07.1 | Red Giant | 298 | 99.76 |
| CE33155_S19 | Myrosinase | A02.2 | Red Giant | 299 | 96.99 |
| CE33155_S19 | Myrosinase | A02.2 | Red Giant | 300 | 98.78 |
| CE33155_S19 | Myrosinase | A03.1 | Red Giant | 301 | 49.4 |
| CE33155_S19 | Myrosinase | A09.1 | Red Giant | 302 | 52.86 |
| CE33155_S19 | Myrosinase | A09.1 | Red Giant | 303 | 51.88 |
| CE33155_S19 | Myrosinase | A09.1 | Red Giant | 304 | 0.66 |
| CE33155_S19 | Myrosinase | B04_cl1.4 | Red Giant | 305 | 99.33 |
| CE33155_S19 | Myrosinase | B04_cl2.1 | Red Giant | 306 | 45.21 |
| CE33155_S19 | Myrosinase | B04_cl2.1 | Red Giant | 307 | 99.22 |
| CE33155_S19 | Myrosinase | B07.1 | Red Giant | 308 | 49.84 |
| CE33155_S19 | Myrosinase | B07.1 | Red Giant | 309 | 45.6 |
| CE33155_S629 | Myrosinase | A02.2 | Red Giant | 310 | 99.75 |
| CE33155_S629 | Myrosinase | A02.2 | Red Giant | 311 | 99.76 |
| CE33155_S629 | Myrosinase | A03.1 | Red Giant | 312 | 56.53 |
| CE33155_S629 | Myrosinase | A09.1 | Red Giant | 313 | 52.48 |
| CE33155_S629 | Myrosinase | A09.1 | Red Giant | 314 | 52.36 |
| CE33155_S629 | Myrosinase | B04_cl1.4 | Red Giant | 315 | 100 |
| CE33155_S629 | Myrosinase | B04_cl2.1 | Red Giant | 316 | 49.22 |
| CE33155_S629 | Myrosinase | B04_cl2.1 | Red Giant | 317 | 99.22 |
| CE33155_S629 | Myrosinase | B07.1 | Red Giant | 318 | 52.39 |
| CE33155_S629 | Myrosinase | B07.1 | Red Giant | 319 | 45.94 |

TABLE 2-continued

Edited Plants

| PLANT | GENE | LOCUS | CULTIVAR | EDITED SEQ ID NO | ALLELE EDIT PERCENTAGE |
|---|---|---|---|---|---|
| CE41658_S113 | Myrosinase | A02.1 | Southern Giant Curl | 320 | 37.17 |
| CE41658_S113 | Myrosinase | A02.1 | Southern Giant Curl | 321 | 5.95 |
| CE41658_S113 | Myrosinase | A02.2 | Southern Giant Curl | 322 | 39.8 |
| CE41658_S113 | Myrosinase | A02.2 | Southern Giant Curl | 323 | 48.19 |
| CE41658_S113 | Myrosinase | A09.1 | Southern Giant Curl | 324 | 10.42 |
| CE41658_S113 | Myrosinase | A09.1 | Southern Giant Curl | 325 | 77.17 |
| CE41658_S113 | Myrosinase | A09.1 | Southern Giant Curl | 326 | 2.97 |
| CE41658_S3 | Myrosinase | A02.1 | Southern Giant Curl | 327 | 0.74 |
| CE41658_S3 | Myrosinase | A02.1 | Southern Giant Curl | 328 | 0.54 |
| CE41658_S3 | Myrosinase | A02.1 | Southern Giant Curl | 329 | 0.61 |
| CE41658_S3 | Myrosinase | A02.1 | Southern Giant Curl | 330 | 0.91 |
| CE41658_S3 | Myrosinase | A02.1 | Southern Giant Curl | 331 | 48.9 |
| CE41658_S3 | Myrosinase | A02.1 | Southern Giant Curl | 332 | 0.54 |
| CE41658_S3 | Myrosinase | A02.1 | Southern Giant Curl | 333 | 0.94 |
| CE41658_S3 | Myrosinase | A02.2 | Southern Giant Curl | 334 | 44.73 |
| CE41658_S3 | Myrosinase | A02.2 | Southern Giant Curl | 335 | 0.51 |
| CE41658_S3 | Myrosinase | A02.2 | Southern Giant Curl | 336 | 45.41 |
| CE41658_S3 | Myrosinase | A03.1 | Southern Giant Curl | 337 | 0.56 |
| CE41658_S3 | Myrosinase | A03.1 | Southern Giant Curl | 338 | 0.92 |
| CE41658_S3 | Myrosinase | A03.1 | Southern Giant Curl | 339 | 0.97 |
| CE41658_S3 | Myrosinase | A03.1 | Southern Giant Curl | 340 | 1.09 |
| CE41658_S3 | Myrosinase | A03.1 | Southern Giant Curl | 341 | 1.51 |
| CE41658_S3 | Myrosinase | A09.1 | Southern Giant Curl | 342 | 96.41 |
| CE41658_S3 | Myrosinase | A09.1 | Southern Giant Curl | 343 | 1.44 |
| CE41658_S3 | Myrosinase | B04_cl1.1 | Southern Giant Curl | 344 | 0.58 |
| CE41658_S3 | Myrosinase | B04_cl1.1 | Southern Giant Curl | 345 | 0.82 |
| CE41658_S3 | Myrosinase | B04_cl1.1 | Southern Giant Curl | 346 | 0.58 |
| CE41658_S3 | Myrosinase | B04_cl1.1 | Southern Giant Curl | 347 | 0.55 |
| CE41658_S3 | Myrosinase | B04_cl1.1 | Southern Giant Curl | 348 | 0.82 |
| CE41658_S3 | Myrosinase | B04_cl1.1 | Southern Giant Curl | 349 | 0.54 |
| CE41658_S3 | Myrosinase | B04_cl1.3 | Southern Giant Curl | 350 | 0.52 |
| CE41658_S3 | Myrosinase | B04_cl1.3 | Southern Giant Curl | 351 | 1.05 |
| CE41658_S3 | Myrosinase | B04_cl1.3 | Southern Giant Curl | 352 | 0.63 |
| CE41658_S3 | Myrosinase | B04_cl1.3 | Southern Giant Curl | 353 | 96.42 |
| CE41658_S3 | Myrosinase | B04_cl1.4 | Southern Giant Curl | 354 | 0.58 |
| CE41658_S3 | Myrosinase | B04_cl1.4 | Southern Giant Curl | 355 | 0.53 |
| CE41658_S3 | Myrosinase | B04_cl1.4 | Southern Giant Curl | 356 | 0.53 |

TABLE 2-continued

Edited Plants

| PLANT | GENE | LOCUS | CULTIVAR | EDITED SEQ ID NO | ALLELE EDIT PERCENTAGE |
|---|---|---|---|---|---|
| CE41658_S3 | Myrosinase | B04_cl2.1 | Southern Giant Curl | 357 | 1.39 |
| CE41658_S3 | Myrosinase | B04_cl2.1 | Southern Giant Curl | 358 | 0.62 |
| CE41658_S3 | Myrosinase | B04_cl2.1 | Southern Giant Curl | 359 | 0.61 |
| CE41824_S121 | Myrosinase | A02.1 | Red Giant | 360 | 1.02 |
| CE41824_S121 | Myrosinase | A02.1 | Red Giant | 361 | 0.96 |
| CE41824_S121 | Myrosinase | A02.1 | Red Giant | 362 | 76.32 |
| CE41824_S121 | Myrosinase | A02.1 | Red Giant | 363 | 4.4 |
| CE41824_S121 | Myrosinase | A02.1 | Red Giant | 364 | 1.6 |
| CE41824_S121 | Myrosinase | A02.1 | Red Giant | 365 | 0.8 |
| CE41824_S121 | Myrosinase | A02.1 | Red Giant | 366 | 1.2 |
| CE41824_S121 | Myrosinase | A02.1 | Red Giant | 367 | 0.75 |
| CE41824_S121 | Myrosinase | A02.1 | Red Giant | 368 | 7.72 |
| CE41824_S121 | Myrosinase | A02.1 | Red Giant | 369 | 12.25 |
| CE41824_S121 | Myrosinase | A02.1 | Red Giant | 370 | 1.26 |
| CE41824_S121 | Myrosinase | A02.1 | Red Giant | 371 | 2.27 |
| CE41824_S121 | Myrosinase | A02.1 | Red Giant | 372 | 49.83 |
| CE41824_S121 | Myrosinase | A02.1 | Red Giant | 373 | 1.17 |
| CE41824_S121 | Myrosinase | A02.1 | Red Giant | 374 | 8.22 |
| CE41824_S121 | Myrosinase | A02.1 | Red Giant | 375 | 7.05 |
| CE41824_S121 | Myrosinase | A02.2 | Red Giant | 376 | 2.24 |
| CE41824_S121 | Myrosinase | A02.2 | Red Giant | 377 | 3.98 |
| CE41824_S121 | Myrosinase | A02.2 | Red Giant | 378 | 2.53 |
| CE41824_S121 | Myrosinase | A02.2 | Red Giant | 379 | 71.82 |
| CE41824_S121 | Myrosinase | A02.2 | Red Giant | 380 | 0.97 |
| CE41824_S121 | Myrosinase | A02.2 | Red Giant | 381 | 1.26 |
| CE41824_S121 | Myrosinase | A03.1 | Red Giant | 382 | 1.86 |
| CE41824_S121 | Myrosinase | A03.1 | Red Giant | 383 | 1.3 |
| CE41824_S121 | Myrosinase | A03.1 | Red Giant | 384 | 53.62 |
| CE41824_S121 | Myrosinase | A03.1 | Red Giant | 385 | 1.02 |
| CE41824_S121 | Myrosinase | A03.1 | Red Giant | 386 | 1.3 |
| CE41824_S121 | Myrosinase | A03.1 | Red Giant | 387 | 17.66 |
| CE41824_S121 | Myrosinase | A09.1 | Red Giant | 388 | 14.12 |
| CE41824_S121 | Myrosinase | A09.1 | Red Giant | 389 | 74.71 |
| CE41824_S121 | Myrosinase | A09.1 | Red Giant | 390 | 85.38 |
| CE41824_S121 | Myrosinase | A09.1 | Red Giant | 391 | 1.01 |
| CE41824_S121 | Myrosinase | B04_cl1.2 | Red Giant | 392 | 88.39 |
| CE41824_S121 | Myrosinase | B04_cl1.2 | Red Giant | 393 | 3.69 |
| CE41824_S121 | Myrosinase | B04_cl1.3 | Red Giant | 394 | 4.48 |
| CE41824_S121 | Myrosinase | B04_cl1.3 | Red Giant | 395 | 83.71 |
| CE41824_S121 | Myrosinase | B04_cl1.4 | Red Giant | 396 | 14.64 |
| CE41824_S121 | Myrosinase | B04_cl1.4 | Red Giant | 397 | 69.73 |
| CE41824_S121 | Myrosinase | B04_cl1.4 | Red Giant | 398 | 2.73 |
| CE41824_S121 | Myrosinase | B04_cl2.1 | Red Giant | 399 | 1.06 |
| CE41824_S121 | Myrosinase | B04_cl2.1 | Red Giant | 400 | 4.72 |
| CE41824_S121 | Myrosinase | B04_cl2.1 | Red Giant | 401 | 79.74 |
| CE41824_S121 | Myrosinase | B04_cl2.1 | Red Giant | 402 | 2.05 |
| CE41824_S121 | Myrosinase | B04_cl2.1 | Red Giant | 403 | 14.5 |
| CE41824_S121 | Myrosinase | B04_cl2.1 | Red Giant | 404 | 14.38 |
| CE41824_S121 | Myrosinase | B04_cl2.1 | Red Giant | 405 | 58.45 |
| CE41824_S121 | Myrosinase | B07.1 | Red Giant | 406 | 0.51 |
| CE41824_S121 | Myrosinase | B07.1 | Red Giant | 407 | 96.37 |
| CE41824_S121 | Myrosinase | B07.1 | Red Giant | 408 | 85.75 |
| CE41824_S121 | Myrosinase | B07.1 | Red Giant | 409 | 2.2 |
| CE41824_S121 | Myrosinase | B07.1 | Red Giant | 410 | 2.81 |
| CE41824_S4 | Myrosinase | A02.1 | Red Giant | 411 | 92.68 |
| CE41824_S4 | Myrosinase | A02.1 | Red Giant | 412 | 19.84 |
| CE41824_S4 | Myrosinase | A02.1 | Red Giant | 413 | 75.3 |
| CE41824_S4 | Myrosinase | A02.1 | Red Giant | 414 | 0.57 |
| CE41824_S4 | Myrosinase | A02.1 | Red Giant | 415 | 0.96 |
| CE41824_S4 | Myrosinase | A02.2 | Red Giant | 416 | 95.24 |
| CE41824_S4 | Myrosinase | A03.1 | Red Giant | 417 | 0.5 |
| CE41824_S4 | Myrosinase | A03.1 | Red Giant | 418 | 0.58 |
| CE41824_S4 | Myrosinase | A03.1 | Red Giant | 419 | 53.45 |
| CE41824_S4 | Myrosinase | A03.1 | Red Giant | 420 | 38.56 |
| CE41824_S4 | Myrosinase | A09.1 | Red Giant | 421 | 0.95 |
| CE41824_S4 | Myrosinase | A09.1 | Red Giant | 422 | 0.57 |
| CE41824_S4 | Myrosinase | A09.1 | Red Giant | 423 | 94.34 |
| CE41824_S4 | Myrosinase | A09.1 | Red Giant | 424 | 45.26 |
| CE41824_S4 | Myrosinase | A09.1 | Red Giant | 425 | 0.56 |
| CE41824_S4 | Myrosinase | A09.1 | Red Giant | 426 | 1.29 |
| CE41824_S4 | Myrosinase | A09.1 | Red Giant | 427 | 14.41 |

TABLE 2-continued

Edited Plants

| PLANT | GENE | LOCUS | CULTIVAR | EDITED SEQ ID NO | ALLELE EDIT PERCENTAGE |
|---|---|---|---|---|---|
| CE41824_S4 | Myrosinase | A09.1 | Red Giant | 428 | 1.72 |
| CE41824_S4 | Myrosinase | A09.1 | Red Giant | 429 | 22.69 |
| CE41824_S4 | Myrosinase | A09.1 | Red Giant | 430 | 0.6 |
| CE41824_S4 | Myrosinase | B04_cl1.2 | Red Giant | 431 | 99.1 |
| CE41824_S4 | Myrosinase | B04_cl1.3 | Red Giant | 432 | 95.33 |
| CE41824_S4 | Myrosinase | B04_cl1.4 | Red Giant | 433 | 4 |
| CE41824_S4 | Myrosinase | B04_cl1.4 | Red Giant | 434 | 95.09 |
| CE41824_S4 | Myrosinase | B04_cl2.1 | Red Giant | 435 | 0.51 |
| CE41824_S4 | Myrosinase | B04_cl2.1 | Red Giant | 436 | 94.84 |
| CE41824_S4 | Myrosinase | B04_cl2.1 | Red Giant | 437 | 96.91 |
| CE41824_S4 | Myrosinase | B04_cl2.1 | Red Giant | 438 | 0.6 |
| CE41824_S4 | Myrosinase | B07.1 | Red Giant | 439 | 97.73 |
| CE41824_S4 | Myrosinase | B07.1 | Red Giant | 440 | 97.66 |
| CE41858_S129 | Myrosinase | A02.1 | Red Giant | 441 | 0.61 |
| CE41858_S129 | Myrosinase | A02.1 | Red Giant | 442 | 1.05 |
| CE41858_S129 | Myrosinase | A02.1 | Red Giant | 443 | 77.27 |
| CE41858_S129 | Myrosinase | A02.1 | Red Giant | 444 | 2.98 |
| CE41858_S129 | Myrosinase | A02.1 | Red Giant | 445 | 5.83 |
| CE41858_S129 | Myrosinase | A02.1 | Red Giant | 446 | 12.82 |
| CE41858_S129 | Myrosinase | A02.1 | Red Giant | 447 | 2.51 |
| CE41858_S129 | Myrosinase | A02.1 | Red Giant | 448 | 3 |
| CE41858_S129 | Myrosinase | A02.1 | Red Giant | 449 | 44.99 |
| CE41858_S129 | Myrosinase | A02.1 | Red Giant | 450 | 8.73 |
| CE41858_S129 | Myrosinase | A02.1 | Red Giant | 451 | 0.85 |
| CE41858_S129 | Myrosinase | A02.1 | Red Giant | 452 | 9.12 |
| CE41858_S129 | Myrosinase | A02.2 | Red Giant | 453 | 1.59 |
| CE41858_S129 | Myrosinase | A02.2 | Red Giant | 454 | 3.37 |
| CE41858_S129 | Myrosinase | A02.2 | Red Giant | 455 | 74.5 |
| CE41858_S129 | Myrosinase | A02.2 | Red Giant | 456 | 0.54 |
| CE41858_S129 | Myrosinase | A03.1 | Red Giant | 457 | 2.46 |
| CE41858_S129 | Myrosinase | A03.1 | Red Giant | 458 | 0.65 |
| CE41858_S129 | Myrosinase | A03.1 | Red Giant | 459 | 2.31 |
| CE41858_S129 | Myrosinase | A03.1 | Red Giant | 460 | 1.86 |
| CE41858_S129 | Myrosinase | A03.1 | Red Giant | 461 | 0.65 |
| CE41858_S129 | Myrosinase | A03.1 | Red Giant | 462 | 3.9 |
| CE41858_S129 | Myrosinase | A03.1 | Red Giant | 463 | 1.11 |
| CE41858_S129 | Myrosinase | A03.1 | Red Giant | 464 | 0.72 |
| CE41858_S129 | Myrosinase | A03.1 | Red Giant | 465 | 54.5 |
| CE41858_S129 | Myrosinase | A09.1 | Red Giant | 466 | 0.61 |
| CE41858_S129 | Myrosinase | A09.1 | Red Giant | 467 | 0.7 |
| CE41858_S129 | Myrosinase | A09.1 | Red Giant | 468 | 0.8 |
| CE41858_S129 | Myrosinase | A09.1 | Red Giant | 469 | 13.93 |
| CE41858_S129 | Myrosinase | A09.1 | Red Giant | 470 | 0.89 |
| CE41858_S129 | Myrosinase | A09.1 | Red Giant | 471 | 0.55 |
| CE41858_S129 | Myrosinase | A09.1 | Red Giant | 472 | 70.77 |
| CE41858_S129 | Myrosinase | A09.1 | Red Giant | 473 | 1.22 |
| CE41858_S129 | Myrosinase | A09.1 | Red Giant | 474 | 82.16 |
| CE41858_S129 | Myrosinase | A09.1 | Red Giant | 475 | 1.01 |
| CE41858_S129 | Myrosinase | B04_cl1.2 | Red Giant | 476 | 0.66 |
| CE41858_S129 | Myrosinase | B04_cl1.2 | Red Giant | 477 | 88.43 |
| CE41858_S129 | Myrosinase | B04_cl1.2 | Red Giant | 478 | 2.74 |
| CE41858_S129 | Myrosinase | B04_cl1.3 | Red Giant | 479 | 0.52 |
| CE41858_S129 | Myrosinase | B04_cl1.3 | Red Giant | 480 | 4.64 |
| CE41858_S129 | Myrosinase | B04_cl1.3 | Red Giant | 481 | 0.77 |
| CE41858_S129 | Myrosinase | B04_cl1.3 | Red Giant | 482 | 0.9 |
| CE41858_S129 | Myrosinase | B04_cl1.3 | Red Giant | 483 | 76.02 |
| CE41858_S129 | Myrosinase | B04_cl1.4 | Red Giant | 484 | 2.21 |
| CE41858_S129 | Myrosinase | B04_cl1.4 | Red Giant | 485 | 1.14 |
| CE41858_S129 | Myrosinase | B04_cl1.4 | Red Giant | 486 | 1.53 |
| CE41858_S129 | Myrosinase | B04_cl1.4 | Red Giant | 487 | 1.02 |
| CE41858_S129 | Myrosinase | B04_cl1.4 | Red Giant | 488 | 1.98 |
| CE41858_S129 | Myrosinase | B04_cl1.4 | Red Giant | 489 | 1.35 |
| CE41858_S129 | Myrosinase | B04_cl1.4 | Red Giant | 490 | 0.81 |
| CE41858_S129 | Myrosinase | B04_cl1.4 | Red Giant | 491 | 0.61 |
| CE41858_S129 | Myrosinase | B04_cl1.4 | Red Giant | 492 | 1.98 |
| CE41858_S129 | Myrosinase | B04_cl1.4 | Red Giant | 493 | 1.53 |
| CE41858_S129 | Myrosinase | B04_cl1.4 | Red Giant | 494 | 0.51 |
| CE41858_S129 | Myrosinase | B04_cl1.4 | Red Giant | 495 | 34.22 |
| CE41858_S129 | Myrosinase | B04_cl1.4 | Red Giant | 496 | 0.61 |
| CE41858_S129 | Myrosinase | B04_cl1.4 | Red Giant | 497 | 24.12 |
| CE41858_S129 | Myrosinase | B04_cl2.1 | Red Giant | 498 | 0.6 |
| CE41858_S129 | Myrosinase | B04_cl2.1 | Red Giant | 499 | 1.27 |
| CE41858_S129 | Myrosinase | B04_cl2.1 | Red Giant | 500 | 0.87 |
| CE41858_S129 | Myrosinase | B04_cl2.1 | Red Giant | 501 | 2.8 |

TABLE 2-continued

Edited Plants

| PLANT | GENE | LOCUS | CULTIVAR | EDITED SEQ ID NO | ALLELE EDIT PERCENTAGE |
|---|---|---|---|---|---|
| CE41858_S129 | Myrosinase | B04_cl2.1 | Red Giant | 502 | 0.5 |
| CE41858_S129 | Myrosinase | B04_cl2.1 | Red Giant | 503 | 74.73 |
| CE41858_S129 | Myrosinase | B04_cl2.1 | Red Giant | 504 | 2.22 |
| CE41858_S129 | Myrosinase | B04_cl2.1 | Red Giant | 505 | 12.99 |
| CE41858_S129 | Myrosinase | B04_cl2.1 | Red Giant | 506 | 0.71 |
| CE41858_S129 | Myrosinase | B04_cl2.1 | Red Giant | 507 | 0.98 |
| CE41858_S129 | Myrosinase | B04_cl2.1 | Red Giant | 508 | 0.84 |
| CE41858_S129 | Myrosinase | B04_cl2.1 | Red Giant | 509 | 0.67 |
| CE41858_S129 | Myrosinase | B04_cl2.1 | Red Giant | 510 | 13.71 |
| CE41858_S129 | Myrosinase | B04_cl2.1 | Red Giant | 511 | 57.66 |
| CE41858_S129 | Myrosinase | B07.1 | Red Giant | 512 | 46.68 |
| CE41858_S129 | Myrosinase | B07.1 | Red Giant | 513 | 46.87 |
| CE41858_S129 | Myrosinase | B07.1 | Red Giant | 514 | 87.4 |
| CE41858_S129 | Myrosinase | B07.1 | Red Giant | 515 | 1.53 |
| CE41858_S129 | Myrosinase | B07.1 | Red Giant | 516 | 3.37 |
| CE41858_S5 | Myrosinase | A02.1 | Red Giant | 517 | 91.04 |
| CE41858_S5 | Myrosinase | A02.1 | Red Giant | 518 | 0.61 |
| CE41858_S5 | Myrosinase | A02.1 | Red Giant | 519 | 17.06 |
| CE41858_S5 | Myrosinase | A02.1 | Red Giant | 520 | 76.89 |
| CE41858_S5 | Myrosinase | A02.1 | Red Giant | 521 | 0.6 |
| CE41858_S5 | Myrosinase | A02.1 | Red Giant | 522 | 0.7 |
| CE41858_S5 | Myrosinase | A02.2 | Red Giant | 523 | 94.05 |
| CE41858_S5 | Myrosinase | A02.2 | Red Giant | 524 | 0.64 |
| CE41858_S5 | Myrosinase | A03.1 | Red Giant | 525 | 0.52 |
| CE41858_S5 | Myrosinase | A03.1 | Red Giant | 526 | 0.84 |
| CE41858_S5 | Myrosinase | A03.1 | Red Giant | 527 | 86.21 |
| CE41858_S5 | Myrosinase | A09.1 | Red Giant | 528 | 0.68 |
| CE41858_S5 | Myrosinase | A09.1 | Red Giant | 529 | 94.73 |
| CE41858_S5 | Myrosinase | A09.1 | Red Giant | 530 | 46.61 |
| CE41858_S5 | Myrosinase | A09.1 | Red Giant | 531 | 0.62 |
| CE41858_S5 | Myrosinase | A09.1 | Red Giant | 532 | 1.42 |
| CE41858_S5 | Myrosinase | A09.1 | Red Giant | 533 | 13.78 |
| CE41858_S5 | Myrosinase | A09.1 | Red Giant | 534 | 2.38 |
| CE41858_S5 | Myrosinase | A09.1 | Red Giant | 535 | 19.49 |
| CE41858_S5 | Myrosinase | A09.1 | Red Giant | 536 | 0.65 |
| CE41858_S5 | Myrosinase | A09.1 | Red Giant | 537 | 0.7 |
| CE41858_S5 | Myrosinase | B04_cl1.2 | Red Giant | 538 | 97.23 |
| CE41858_S5 | Myrosinase | B04_cl1.3 | Red Giant | 539 | 92.24 |
| CE41858_S5 | Myrosinase | B04_cl1.4 | Red Giant | 540 | 2.01 |
| CE41858_S5 | Myrosinase | B04_cl1.4 | Red Giant | 541 | 1.23 |
| CE41858_S5 | Myrosinase | B04_cl1.4 | Red Giant | 542 | 50.91 |
| CE41858_S5 | Myrosinase | B04_cl1.4 | Red Giant | 543 | 41.03 |
| CE41858_S5 | Myrosinase | B04_cl2.1 | Red Giant | 544 | 0.5 |
| CE41858_S5 | Myrosinase | B04_cl2.1 | Red Giant | 545 | 91.77 |
| CE41858_S5 | Myrosinase | B04_cl2.1 | Red Giant | 546 | 96.1 |
| CE41858_S5 | Myrosinase | B04_cl2.1 | Red Giant | 547 | 0.57 |
| CE41858_S5 | Myrosinase | B07.1 | Red Giant | 548 | 47.4 |
| CE41858_S5 | Myrosinase | B07.1 | Red Giant | 549 | 49.75 |
| CE41858_S5 | Myrosinase | B07.1 | Red Giant | 550 | 96.51 |
| CE41984_S144 | Myrosinase | A01.1 | Red Giant | 551 | 93.15 |
| CE41984_S144 | Myrosinase | A02.1 | Red Giant | 552 | 0.54 |
| CE41984_S144 | Myrosinase | A02.1 | Red Giant | 553 | 89.53 |
| CE41984_S144 | Myrosinase | A02.1 | Red Giant | 554 | 72.4 |
| CE41984_S144 | Myrosinase | A02.1 | Red Giant | 555 | 0.5 |
| CE41984_S144 | Myrosinase | A02.1 | Red Giant | 556 | 6.58 |
| CE41984_S144 | Myrosinase | A02.1 | Red Giant | 557 | 8.67 |
| CE41984_S144 | Myrosinase | A02.1 | Red Giant | 558 | 1.49 |
| CE41984_S144 | Myrosinase | A03.1 | Red Giant | 559 | 3.32 |
| CE41984_S144 | Myrosinase | A03.1 | Red Giant | 560 | 78.96 |
| CE41984_S144 | Myrosinase | A03.1 | Red Giant | 561 | 2.84 |
| CE41984_S144 | Myrosinase | A03.1 | Red Giant | 562 | 1.82 |
| CE41984_S144 | Myrosinase | A03.1 | Red Giant | 563 | 0.6 |
| CE41984_S144 | Myrosinase | A03.1 | Red Giant | 564 | 80.86 |
| CE41984_S144 | Myrosinase | A03.1 | Red Giant | 565 | 0.51 |
| CE41984_S144 | Myrosinase | B04_cl1.3 | Red Giant | 566 | 100 |
| CE41984_S144 | Myrosinase | B04_cl2.1 | Red Giant | 567 | 3.63 |
| CE41984_S144 | Myrosinase | B04_cl2.1 | Red Giant | 568 | 2.31 |
| CE41984_S144 | Myrosinase | B04_cl2.1 | Red Giant | 569 | 79.21 |
| CE41984_S144 | Myrosinase | B07.1 | Red Giant | 570 | 97.38 |
| CE41984_S7 | Myrosinase | A01.1 | Red Giant | 571 | 97.05 |
| CE41984_S7 | Myrosinase | A02.1 | Red Giant | 572 | 94.7 |
| CE41984_S7 | Myrosinase | A02.1 | Red Giant | 573 | 96.88 |
| CE41984_S7 | Myrosinase | A03.1 | Red Giant | 574 | 94.74 |
| CE41984_S7 | Myrosinase | A03.1 | Red Giant | 575 | 1.2 |

TABLE 2-continued

Edited Plants

| PLANT | GENE | LOCUS | CULTIVAR | EDITED SEQ ID NO | ALLELE EDIT PERCENTAGE |
|---|---|---|---|---|---|
| CE41984_S7 | Myrosinase | A03.1 | Red Giant | 576 | 0.95 |
| CE41984_S7 | Myrosinase | A03.1 | Red Giant | 577 | 91.73 |
| CE41984_S7 | Myrosinase | B04_cl1.3 | Red Giant | 578 | 100 |
| CE41984_S7 | Myrosinase | B04_cl2.1 | Red Giant | 579 | 98.63 |
| CE41984_S7 | Myrosinase | B07.1 | Red Giant | 580 | 98.76 |
| CE41986_N2_S150 | Myrosinase | A09.1 | Red Giant | 581 | 94.98 |
| CE41986_N2_S150 | Myrosinase | B04_cl2.1 | Red Giant | 582 | 80.33 |
| CE41986_S152 | Myrosinase | A02.1 | Red Giant | 583 | 88.44 |
| CE41986_S152 | Myrosinase | A02.1 | Red Giant | 584 | 8.16 |
| CE41986_S152 | Myrosinase | A09.1 | Red Giant | 585 | 7.12 |
| CE41986_S152 | Myrosinase | A09.1 | Red Giant | 586 | 91.53 |
| CE41986_S152 | Myrosinase | B04_cl2.1 | Red Giant | 587 | 71.43 |
| CE41986_S152 | Myrosinase | B04_cl2.1 | Red Giant | 588 | 7.94 |
| CE41986_S8 | Myrosinase | A01.1 | Red Giant | 589 | 95.18 |
| CE41986_S8 | Myrosinase | A01.1 | Red Giant | 590 | 2.53 |
| CE41986_S8 | Myrosinase | A02.1 | Red Giant | 591 | 95.02 |
| CE41986_S8 | Myrosinase | A02.1 | Red Giant | 592 | 99.23 |
| CE41986_S8 | Myrosinase | A03.1 | Red Giant | 593 | 99.37 |
| CE41986_S8 | Myrosinase | A03.1 | Red Giant | 594 | 89.34 |
| CE41986_S8 | Myrosinase | A09.1 | Red Giant | 595 | 98.7 |
| CE41986_S8 | Myrosinase | B04_cl1.4 | Red Giant | 596 | 5.29 |
| CE41986_S8 | Myrosinase | B04_cl1.4 | Red Giant | 597 | 94.71 |
| CE41986_S8 | Myrosinase | B07.1 | Red Giant | 598 | 1.3 |
| CE41986_S8 | Myrosinase | B07.1 | Red Giant | 599 | 95.96 |
| CE36897_S305 | AOP2 | BjuB018584 | Green Wave | 600 | 0.89 |
| CE36897_S305 | AOP2 | BjuB018584 | Green Wave | 601 | 44.11 |
| CE36897_S305 | AOP2 | BjuB018584 | Green Wave | 602 | 0.89 |
| CE36897_S305 | AOP2 | BjuB018584 | Green Wave | 603 | 0.59 |
| CE36897_S305 | AOP2 | BjuB018584 | Green Wave | 604 | 98.95 |
| CE36897_S305 | AOP2 | BjuB000368 | Green Wave | 605 | 56.72 |
| CE36897_S305 | AOP2 | BjuB000368 | Green Wave | 606 | 41.43 |
| CE36897_S305 | AOP2 | BjuA007827 | Green Wave | 607 | 99.63 |
| CE34664_S7 | AOP2 | BjuA007827 | Green Wave | 608 | 49.63 |
| CE34664_S7 | AOP2 | BjuA007827 | Green Wave | 609 | 50.08 |
| CE_34664_S617 | AOP2 | BjuB018584 | Green Wave | 610 | 99.52 |
| CE_34664_S617 | AOP2 | BjuB018584 | Green Wave | 611 | 0.68 |
| CE_35423_S633 | AOP2 | BjuB018584 | Green Wave | 612 | 4.7 |
| CE36443_S671 | AOP2 | BjuB000368 | Green Wave | 613 | 40.74 |
| CE36443_S671 | AOP2 | BjuA031496 | Green Wave | 614 | 75.25 |
| CE36897_S664 | AOP2 | BjuB018584 | Green Wave | 615 | 23.88 |
| CE36897_S664 | AOP2 | BjuB018584 | Green Wave | 616 | 22.97 |
| EPS3531 | CYP79F1 | BjuB021730 | Green Wave | 788 | 3 |
| EPS3531 | CYP79F1 | BjuB021730 | Green Wave | 789 | 2 |
| EPS3531 | CYP79F1 | BjuB021730 | Green Wave | 790 | 2 |
| EPS3531 | CYP79F1 | BjuB021730 | Green Wave | 791 | 2 |
| EPS3531 | CYP79F1 | BjuB021730 | Green Wave | 792 | 1 |
| EPS3531 | CYP79F1 | BjuB021730 | Green Wave | 793 | 1 |
| EPS3532 | CYP79F1 | BjuB021730 | Green Wave | 794 | 22 |
| EPS3532 | CYP79F1 | BjuB021730 | Green Wave | 794 | 37 |
| EPS3532 | CYP79F1 | BjuB021730 | Green Wave | 796 | 20 |
| EPS3532 | CYP79F1 | BjuB021730 | Green Wave | 797 | 5 |
| EPS3532 | CYP79F1 | BjuB021730 | Green Wave | 798 | 5 |
| EPS3532 | CYP79F1 | BjuB021730 | Green Wave | 799 | 38 |
| CE34664 | AOP2 | BjuA010951_BjuA010952 A03_aop2 | Green Wave | 800 | 0.99 |
| CE35423 | AOP2 | BjuA010951_BjuA010952 A03_aop2 | Green Wave | 801 | 0.48 |
| CE35423 | AOP2 | BjuA010951_BjuA010952 A03_aop2 | Green Wave | 802 | 0.43 |
| CE35423 | AOP2 | BjuA010951_BjuA010952 A03_aop2 | Green Wave | 803 | 0.06 |
| CE36896 | AOP2 | BjuA010951_BjuA010952 A03_aop2 | Green Wave | 804 | 0.02 |
| CE36896 | AOP2 | BjuA010951_BjuA010952 A03_aop2 | Green Wave | 805 | 0.01 |
| CE36897 | AOP2 | BjuA010951_BjuA010952 A03_aop2 | Green Wave | 806 | 0.09 |
| CE36897 | AOP2 | BjuA010951_BjuA010952 A03_aop2 | Green Wave | 807 | 0.88 |
| CE36897 | AOP2 | BjuA010951_BjuA010952 A03_aop2 | Green Wave | 808 | 0.07 |
| CE36897 | AOP2 | BjuA010951_BjuA010952 A03_aop2 | Green Wave | 809 | 0.03 |

TABLE 2-continued

Edited Plants

| PLANT | GENE | LOCUS | CULTIVAR | EDITED SEQ ID NO | ALLELE EDIT PERCENTAGE |
|---|---|---|---|---|---|
| CE36897 | AOP2 | BjuA010951_BjuA010952 A03_aop2 | Green Wave | 810 | 0.01 |
| CE36897 | AOP2 | BjuA010951_BjuA010952 A03_aop2 | Green Wave | 811 | 0.29 |
| CE38248 | AOP2 | BjuA010951_BjuA010952 A03_aop2 | Green Wave | 812 | 0.39 |
| CE38248 | AOP2 | BjuA010951_BjuA010952 A03_aop2 | Green Wave | 813 | 0.47 |
| CE38248 | AOP2 | BjuA010951_BjuA010952 A03_aop2 | Green Wave | 814 | 0.4 |
| CE38248 | AOP2 | BjuA010951_BjuA010952 A03_aop2 | Green Wave | 815 | 0.08 |
| CE38248 | AOP2 | BjuA010951_BjuA010952 A03_aop2 | Green Wave | 816 | 0.39 |

TABLE 4

Phenotypic data

| CEID | Cultivar | Generation | Days after planting | GRA |
|---|---|---|---|---|
| CE15785 | Red Giant | E0 | 56 | NA |
| CE15788 | Red Giant | E0 | 56 | NA |
| CE18322 | Red Giant | E0 | 28 | NA |
| CE18324 | Red Giant | E0 | 28 | NA |
| CE33147 (CE15785 clone) | Red Giant | E0 | 18 | 0.07 |
| CE33150 (CE15788 clone) | Red Giant | E0 | 18 | 0.05 |
| CE33152 (CE18322 clone) | Red Giant | E0 | 18 | 0.23 |
| CE33155 (CE18324 clone) | Red Giant | E0 | 18 | 0.07 |
| CE41824 | Red Giant | E1 | 19 | 0.14 |
| CE41824 | Red Giant | E1 | 36 | 0.11 |
| CE41824 | Red Giant | E1 | 44 | 0.12 |
| CE41858 | Red Giant | E1 | 19 | 0.22 |
| CE41858 | Red Giant | E1 | 36 | 0.16 |
| CE41858 | Red Giant | E1 | 44 | 0.21 |
| CE41984 | Red Giant | E1 | 19 | 0.09 |
| CE41984 | Red Giant | E1 | 28 | 0.29 |
| CE41984 | Red Giant | E1 | 36 | 0.19 |
| CE41984 | Red Giant | E1 | 44 | 0.27 |
| CE41986 | Red Giant | E1 | 19 | 0.12 |
| CE41986 | Red Giant | E1 | 28 | 0.04 |
| CE41986 | Red Giant | E1 | 36 | 0.12 |
| CE41986 | Red Giant | E1 | 44 | 0.11 |
| CE42072 | Red Giant | WT | 19 | 1.51 |
| CE42072 | Red Giant | WT | 28 | 1.51 |
| CE42073 | Red Giant | WT | 19 | 2.17 |
| CE42073 | Red Giant | WT | 28 | 1.83 |
| CE42074 | Red Giant | WT | 19 | 1.92 |
| CE42074 | Red Giant | WT | 28 | 1.66 |
| CE42075 | Red Giant | WT | 19 | 1.82 |
| CE42077 | Red Giant | WT | 19 | 2.28 |
| CE42077 | Red Giant | WT | 28 | 1.76 |
| CE42078 | Red Giant | WT | 28 | 2.24 |
| CE42082 | Red Giant | WT | 36 | 2.04 |
| CE42082 | Red Giant | WT | 44 | 2.90 |
| CE42102 | Red Giant | WT | 36 | 2.61 |
| CE42102 | Red Giant | WT | 44 | 3.14 |
| CE42107 | Red Giant | WT | 36 | 2.62 |
| CE42107 | Red Giant | WT | 44 | 2.88 |
| CE42112 | Red Giant | WT | 36 | 2.29 |
| CE42112 | Red Giant | WT | 44 | 2.87 |
| CE42117 | Red Giant | WT | 36 | 2.49 |
| CE42117 | Red Giant | WT | 44 | 2.37 |
| CE21573 | Southern Giant Curled | E0 | 47 | 0.32 |
| CE29601 | Southern Giant Curled | E0 | 27 | 0.06 |
| CE31357 | Southern Giant Curled | E0 | 25 | 0.21 |
| CE41658 | Southern Giant Curled | E1 | 19 | 0.27 |
| CE41658 | Southern Giant Curled | E1 | 28 | 0.40 |
| CE41658 | Southern Giant Curled | E1 | 36 | 0.37 |
| CE41658 | Southern Giant Curled | E1 | 44 | 0.45 |
| CE42024 | Southern Giant Curled | WT | 19 | 2.07 |
| CE42024 | Southern Giant Curled | WT | 28 | 2.63 |
| CE42025 | Southern Giant Curled | WT | 19 | 2.42 |
| CE42025 | Southern Giant Curled | WT | 28 | 2.08 |
| CE42026 | Southern Giant Curled | WT | 19 | 2.33 |
| CE42026 | Southern Giant Curled | WT | 28 | 2.01 |
| CE42027 | Southern Giant Curled | WT | 19 | 2.48 |
| CE42027 | Southern Giant Curled | WT | 28 | 2.66 |
| CE42028 | Southern Giant Curled | WT | 19 | 1.08 |
| CE42028 | Southern Giant Curled | WT | 28 | 2.33 |
| CE42048 | Southern Giant Curled | WT | 36 | 2.26 |
| CE42048 | Southern Giant Curled | WT | 44 | 3.55 |
| CE42052 | Southern Giant Curled | WT | 36 | 2.66 |
| CE42052 | Southern Giant Curled | WT | 44 | 2.97 |
| CE42062 | Southern Giant Curled | WT | 36 | 2.68 |
| CE42062 | Southern Giant Curled | WT | 44 | 3.06 |
| CE42066 | Southern Giant Curled | WT | 36 | 2.70 |
| CE42066 | Southern Giant Curled | WT | 44 | 3.10 |
| CE42071 | Southern Giant Curled | WT | 36 | 2.49 |
| CE42071 | Southern Giant Curled | WT | 44 | 2.89 |

TABLE 5

Loci and associated sequence identifier in three Brassica juncea varieties

| SEQ ID NO: | Locus | Cultivar |
|---|---|---|
| 680 | A01.1-myr | Green_Wave |
| 681 | A01.1-myr | Southern_Giant_Curled |
| 682 | A01.1-myr | Red_Giant |
| 683 | A02.1-myr | Green_Wave |
| 684 | A02.1-myr | Red_Giant |
| 685 | A02.1-myr | Southern_Giant_Curled |
| 686 | A02.3-myr | Green_Wave |
| 687 | A02.3-myr | Red_Giant |

TABLE 5-continued

Loci and associated sequence identifier in three *Brassica juncea* varieties

| SEQ ID NO: | Locus | Cultivar |
|---|---|---|
| 688 | A02.3-myr | Southern_Giant_Curled |
| 689 | A02.2-myr | Green_Wave |
| 690 | A02.2-myr | Red_Giant |
| 691 | A02.2-myr | Southern_Giant_Curled |
| 692 | A03.1-myr | Green_Wave |
| 693 | A03.1-myr | Red_Giant |
| 694 | A03.1-myr | Southern_Giant_Curled- |
| 695 | A09.1-myr | Green_Wave |
| 696 | A09.1-myr | Red_Giant |
| 697 | A09.1-myr | Southern_Giant_Curled |
| 698 | B04_cl3.1-myr | Green_Wave |
| 699 | B04_cl3.1-myr | Red_Giant |
| 700 | B04_cl3.1-myr | Southern_Giant_Curled |
| 701 | B04_cl1.1-myr | Green_Wave |
| 702 | B04_cl1.1-myr | Red_Giant- |
| 703 | B04_cl1.1-myr | Southern_Giant_Curled |
| 704 | B04_cl1.2-myr | Green_Wave |
| 705 | B04_cl1.2-myr | Red_Giant |
| 706 | B04_cl1.2-myr | Southern_Giant_Curled |
| 707 | B04_cl1.3-myr | Green_Wave |
| 708 | B04_cl1.3-myr | Red_Giant |
| 709 | B04_cl1.3-myr | Southern_Giant_Curled |
| 710 | B04_cl1.4-myr | Green_Wave |
| 711 | B04_cl1.4-myr | Red_Giant |
| 712 | B04_cl1.4-myr | Southern_Giant_Curled |
| 713 | B04_cl2.1-myr | Green_Wave |
| 714 | B04_cl2.1-myr | Red_Giant |
| 715 | B04_cl2.1-myr | Southern_Giant_Curled |
| 716 | B07.1-myr | Green_Wave |
| 717 | B07.1-myr | Red_Giant |
| 718 | B07.1-myr | Southern_Giant_Curled |
| 719 | B07.2-myr | Green_Wave |
| 720 | B07.2-myr | Red_Giant |
| 721 | B07.2-myr | Southern_Giant_Curled |
| 722 | BjuA007827_AOP2 | Green_Wave |
| 723 | BjuA007827_AOP2 | Red_Giant |
| 724 | BjuA007827_AOP2 | Southern_Giant_Curled |
| 725 | BjuA010951_BjuA010952_AOP2 | Green_Wave |
| 726 | BjuA010951_BjuA010952_AOP2 | Red_Giant |
| 727 | BjuA010951_BjuA010952_AOP2 | Southern_Giant_Curled |
| 728 | BjuA031496_AOP2 | Green_Wave |
| 729 | BjuA031496_AOP2 | Southern_Giant_Curled |
| 730 | BjuA031496_AOP2 | Red_Giant |
| 731 | BjuB000368_AOP2 | Green_Wave |
| 732 | BjuB000368_AOP2 | Red_Giant |
| 733 | BjuB000368_AOP2 | Southern_Giant_Curled |
| 734 | BjuB018584_AOP2 | Green_Wave |
| 735 | BjuB018584_AOP2 | Red_Giant |
| 736 | BjuB018584_AOP2 | Southern_Giant_Curled |
| 737 | BjuA022066-Cyp79fl | Green_Wave |
| 738 | BjuA022066-Cyp79fl | Red_Giant |
| 739 | BjuA022066-Cyp79fl | Southern_Giant_Curled |
| 740 | BjuB021730-Cyp79fl | Green_Wave |
| 741 | BjuB021730-Cyp79fl | Red_Giant |
| 742 | BjuB021730-Cyp79fl | Southern_Giant_Curled |

SEQUENCE LISTING (828 sequences)

SEQ ID NO: 1 - protein, 1227 aa, Unknown
  Lachnospiraceae bacterium
SKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 2 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 3 - protein, 1241 aa, Butyrivibrio proteoclasticus
MLLYENYTKRNQITKSLRLELRPQGKTLRNIKELNLLEQDKAIYALLERLKPVIDEGIKDIARDTLKNCELSFEKLYEHFLSGDKKAYAKESERLKKEIVKTLIKNLPEGIGKISEINSAKYLNGVLYDFIDKTHKDSEEKQNILSDILETKGYLALFSKFLTSRITTLEQSMPKRVIENFEIYAANIPKMQDALERGAVSFAIEYESICSVDYYNQILSQEDIDSYNRLISGIMDEDGAKEKGINQTISEKNIKIKSEHLEEKPFRILKQLHKQILEEREKAFTIDHIDSDEEVVQVTKEAFEQTKEQWENIKKINGFYAKDPGDITLFIVVGPNQTHVLSQLIYGEHDRIRLLLEEYEKNTLEVLPRRTKSEDARYDKFVNAVPKKVAKESHTFDGLQKMTGDDRLFILYRDELARNYMRIKEAYGTFERDILKSRRGIKGNRDVQESLVSFYDELTKFRSALRIINSGNDEKADPIFYNTFDGIFEKANRTYKAENLCRNYVTKSPADDARIMASCLGTPARLRTHWWNGEENFAINDVAMIRRGDEYYYFVLTPDVKPVDLKTKDETDAQIFVQRKGAKSFLGLPKALFKCILEPYFESPEHKNDKNCVIEEYVSKPLTIDRRAYDIFKNGTFKKTNIGIDGLTEEKFKDDCRYLIDVYKEFIAVYTRYSCFNMSGLKRADEYNDIGEFFSDVDTRLCTMEWIPVSFERINDMVDKKEGLLFLVRSMFLYNRPRKPYERTFIQLFSDSNMEHTSMLLNSRAMIQYRAASLPRRVTHKKGSILVALRDSNGEHIPMHIREAIYKMKNNFDISSEDFIMAKAYLAEHDVAIKKANEDIIRNRRYTEDKFFLSLSYTKNADISARTLDYINDKVEEDTQDSRMAVIVTRNLKDLTYVAVVDEKNNVLEEKSLNEIDGVNYRELLKERTKIKYHDKTRLWQYDVSSKGLKEAYVELAVTQISKLATKYNAVVVVESMSSTFKDKFSFLDEQIFKAFEARLCARMSDLSFNTIKEGEAGSISNPIQVSNNNGNSYQDGVIYFLNNAYTRTLCPDTGFVDVFDKTRLITMQSKRQFFAKMKDIRIDDGEMLFTFNLEEYPTKRLLDRKEWTVKIAGDGSYFDKDKGEYVYVNDIVREQIIPALLEDKAVFDGNMAEKFLDKTAISGKSVELIYKWFANALYGIITKKDGEKIYRSPITGTEIDVSKNTTYNFGKKFMFKQEYRGDGDFLDAFLNYMQAQDIAV

SEQ ID NO: 4 - protein, 1238 aa, Candidatus Methanoplasma termitum
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDIVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIDRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLRPVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 5 - protein, 1281 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLDKIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 6 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKVNYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 7 - protein, 1206 aa, Unknown
  Lachnospiraceae bacterium
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSVIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFDTQASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGLYLQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 8 - protein, 1233 aa, Unknown
  Lachnospiraceae bacterium
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKKLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLIN

SEQ ID NO: 9 - protein, 1227 aa, Unknown
  Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIANINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIASNKEWLEYAQTSVKH

SEQ ID NO: 10 - protein, 1264 aa, Unknown
  Lachnospiraceae bacterium
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYNKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNPLNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDISGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 11 - protein, 1373 aa, Moraxella bovoculi
MLFQDFTHLYPLSKTVRFELFIDRTLEHIHAKNFLSQDETMADMHQKVKVILDDYHRDFIADMMGEVKLTKLAEFYDVYLKFRKNPKDDELQKAQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFKDINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQKDFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIQASQAFFGKFDKICYNADKDYFEFHIDYAKFTDKAKNSRQIWTICSHGDKRYVYDKTANQNKGAAKGINVNDILKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 12 - protein, 1352 aa, Unknown
  Parcubacteria bacterium
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITESKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKIKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 13 - protein, 1260 aa, Porphyromonas crevioricanis
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 14 - protein, 1324 aa, Prevotella disiens
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIDALKGFYIEDGFENNVLTPLATLLSSLDKYNLNGIFIRNNEALSSLSQNVYRNFSIDEAIDAQNAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNKDDLNLSISSTEWLDFVREKPYLK

SEQ ID NO: 15 - protein, 1484 aa, Peregrinibacteria bacterium
  misc_feature (1073)..(1073): Xaa can be any naturally occurring amino acid
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAMIKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTWIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDXWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKKKRPAATKK

SEQ ID NO: 16 - protein, 1245 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSISEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQHGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 17 - protein, 1250 aa, Smithella sp.
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYQWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKG

SEQ ID NO: 18 - DNA, 3987 bp, Artificial
  enasCPf1
atggccgggagcaagaagcgccggataaagcaggacacgcagttcgagggcttcaccaacctgtaccaagtctccaagacgctccggttcgagcttatcccgcaagggaagaccctgaaacacatccaggaacaaggtttcatcgaggaggacaaggcccgcaacgaccactacaaggagctcaagcccataatcgatcggatctacaagacgtacgccgaccagtgcctccaactggtgcagctcgactgggagaacctgagcgccgccattgacagctaccgcaaggaaaagacggaggagacgcgcaacgcccttattgaggagcaagccacctaccgcaacgccatccacgactacttcatcgggcgcaccgacaacctgacggacgcgatcaacaagcgccacgcggaaatctacaagggccttttcaaggccgagctcttcaacgggaaggtcctaaaacagctcgggactgtcacgacaaccgagcatgagaacgccctccttcgcagcttcgacaagttcaccacatacttctcgggcttctaccggaaccgcaagaacgttttcagcgccgaggacatctccaccgccatcccgcacaggatcgtccaggacaacttccccaagttcaaggagaactgccacatcttcacgcgcctgattacagccgtaccttcacttcgtgagcacttcgagaacgtcaaaaaggccatcgggatcttcgtctccacgtccatcgaggaggtattctctttcccgttctataaccagctcctgacccagacgcagatcgacctctacaaccagctactgggcggcatcagccgggaggccgggaccgagaaaataaagggcctcaacgaagttctcaacctggccatccagaagaacgacgagaccgcgcatatcatcgcatccctgccgcatcgcttcattcctttgttcaagcagatattgagcgaccggaacaccctctcgttcatcctcgaagaattcaagagcgacgaggaggtcattcagtctttctgcaagtacaagacgctcctacggaatgagaatgtgctggagaccgcggaggcactcttcaatgagctgaactccattgacctgacccacatcttcattagccacaagaaactggagacgatctccagcgccctgtgcgaccactgggacactctccgcaacgccctctacgaacgccggatctccgaacttaccggcaagataactaagtcggctaaggagaaggtgcaacggagcctcaagcacgaggacatcaaccttcaggaaatcatctcagccgcgggcaaggagctgagcgaggcgtttaagcagaaaacatcggagatactgagccacgcgcacgcggccctggatcaaccgctgccgacgactctcaagaagcaagaggagaaggaaatccttaagtcccagctcgactcgctgctcggcctctatcacttgctcgactggttcgcggttgatgagtccaacgaggtggacccggagttctccgcgcgcctcacgggtattaagctggagatggagccaagcttaagcttctacaacaaggcccgcaactacgcgaccaaaaaaccgtactcagtcgagaaattcaagctgaatttccagatgcctacattggcgagggggtgggacgtgaaccgcgagaagaacaatggagccatcctgttcgtcaaaaatgggttgtactacctgggcatcatgcccaagcagaagggccgttacaaggccctgtcattcgagcctaccgagaagacctcggagggcttcgacaagatgtactacgactatttcccggacgccgccaagatgatcccgaagtgctccacgcagctcaaagccgtcacggcccacttccagacgcataccacgccgatacttctgagcaacaacttcattgagccgctagagatcacgaaggagatatacgacctaaacaaccccgaaaaggagcccaagaagttccagacagcctacgctaagaagacaggtgatcagaagggatatagggaggcactctgcaagtggatcgacttcacgcgcgacttcctgtcgaaatatacaaagacgaccagcattgacctaagttctctccgcccatcctcccagtacaaggatctgggcgagtattatgcggagctgaacccattgctgtaccacatcagcttccagaggatcgccgagaaggagattatggacgcggtggagacggggaaactatacctgttccaaatatataacaaggacttcgctaaagggcaccacgggaagcccaacctgcacacactctactggacgggcttgttttcgccagaaaatttggccaagacttcgatcaagctcaacggccaggcggagttgttttaccgtcccaagtctcgcatgaagcgcatggcgcatcgcctcggagagaaaatgcttaacaagaagctcaaggatcagaagacgcccatacctgatacgttgtaccaggaattgtacgactacgtgaaccaccgcctatcgcacgacctctcagacgaggcccgcgccctcctcccaaacgtgattactaaggaggtttcccatgaaataatcaaggaccgacggttcaccagcgacaaattttttttccacgtgcctatcacgctcaattaccaggcggccaactccccatcgaagttcaaccagcgcgtgaacgcctaccttaaggagcacccggagaccccaatcatcgggatcgaccgtggcgagcggaacctgatctatattacggtgatcgatagcaccgggaagatcctggagcagcgctccctgaacacaatccagcagtttgactaccagaagaaactcgacaaccgggagaaggagcgcgtcgcagcccggcaagcatggagtgtggtcggcaccataaaggacctgaaacagggttacctaagtcaagttatccacgagatcgttgacctgatgatacactatcaagccgtagtcgtgctggagaacctcaacttcgggtttaagtccaagcgcaccggcatcgcggagaaggcggtgtaccagcagttcgagaagatgctgatcgacaagctgaactgcctggtgctcaaggactaccctgcggagaaggtcggcggggtcttgaacccgtaccagctaaccgaccagttcacgagcttcgccaaaatgggcacgcagtccggattcttgttttatgtcccggctccatatacaagtaagatcgacccgctgacagggtttgttgacccattcgtgtggaagaccatcaagaaccacgagagcaggaaacacttcttagagggcttcgacttcctgcattacgacgttaagacaggcgacttcatcctgcacttcaagatgaaccgcaacctgtcgttccagaggggcctgcccggcttcatgcccgcctgggatatcgtctttgagaagaatgagacgcagttcgacgcgaaggggacgccgttcatcgctggaaagcggatcgtgccggtcatcgagaaccaccgcttcacgggtcgctaccgagatttataccccgccaacgaactaattgcgctgctggaggagaaggggatcgtgttccgagatggcagcaacattctcccgaagctgctggagaacgacgactcgcacgctattgacacgatggtcgccctcatacggagcgtgcttcagatgcggaacagtaacgctgccacgggcgaggactacattaactcccccgtccgcgacctcaacggggtctgcttcgatagccgcttccagaacccggagtggcctatggatgcggacgcgaacggggcctaccacatcgccctcaagggccaactcctgctcaaccacttgaaggaaagcaaagacctcaaattgcagaatggcatcagtaaccaggactggctcgcgtacatccaggaactgagaaacgggtccaagaagcggcgtatcaagcaagattga

SEQ ID NO: 19 - DNA, 3987 bp, Artificial
  enasCPf1
atggcgggaagcaaaaagcgccggattaagcaagacacgcagttcgagggcttcacgaacctctaccaagtcagcaagaccctccggttcgagctgataccacagggaaagacgctcaagcacatccaggaacagggcttcatcgaggaggacaaggcgcgcaacgaccactacaaggagttgaaaccgatcatcgaccgcatctacaagacgtacgccgaccagtgcctccagctcgtgcagctcgactgggagaacctctccgccgccattgactcgtaccggaaggagaagactgaggagacccgcaacgccctgatcgaggagcaagcaacctaccggaacgccatccacgactacttcatcggccgcaccgacaacctcaccgacgcgatcaacaagcggcacgcggagatatacaaagggctgttcaaggcggagctgttcaacggcaaggtgctcaagcagctagggacggtgaccacgaccgagcacgagaacgcgctcctccgcagcttcgacaagttcaccacctacttcagcggcttctaccggaaccgcaagaatgtgttcagcgcggaggacatcagcacggccatcccgcaccgcatcgtccaggacaacttcccgaagttcaaggagaactgccacatcttcacccgcctgataaccgccgtcccctccctgcgggagcacttcgagaacgtcaaaaaggcaattgggatcttcgtctcgaccagcattgaggaggtgttcagcttccccttctacaaccagctcctcacccagacgcagatcgacctgtacaatcagttgctcggcgggataagccgcgaggcgggaaccgaaaaaatcaaggggctgaacgaagtgttgaacctcgccatccagaagaacgacgagaccgcgcacatcatcgcctccctgccccaccggttcatcccgctgttcaagcagatcctctctgaccggaacaccctgtccttcattcttgaggagttcaagtcggacgaggaggtcatccagagcttctgcaagtacaagacgctgctacggaacgagaacgtgctggagacggcggaggcactgttcaacgagctaaacagcatcgacctcacgcacatcttcatcagtcacaagaaactggagaccatctcctccgcgctgtgcgaccactgggacacgctcaggaacgcgctctacgagcgccgaatcagtgagctgacgggcaagatcacgaagtccgcgaaggagaaggtgcagcggtccctcaagcacgaggacatcaacctccaggagatcatctcagcggctgggaaagagctgtccgaggcgttcaagcagaaaacgagcgaaatcctgtcccacgcgcacgcggccctggatcagcctctgccgacgaccctcaagaaacaagaagaaaaggaaatcctcaagtcgcagctcgactcgctgctgggcctgtaccatctcctcgactggttcgccgtggacgagagcaacgaggtggaccccgagttctccgcgcggcttacggggatcaagctggagatggagcccagcctgtccttctacaacaaggcgcgcaactacgccaccaagaagccctacagcgtggagaagttcaagctcaacttccagatgcccactctcgcacgtgggtgggacgtcaaccgcgaaaaaaataatggggcgatcctgttcgtcaagaacggcctgtactacttgggcatcatgccgaaacagaagggccgctacaaggccctgagcttcgaaccgaccgagaaaacgagcgaggggttcgacaagatgtactacgactacttccccgacgccgcgaagatgattccaaagtgctccacgcagcttaaggccgtgacggcccacttccagacgcacacgaccccgatcctcctcagcaacaacttcatcgagcccctggagatcacgaaggagatatacgacctgaacaacccggagaaggagcccaagaaattccagaccgcctacgccaagaagacaggcgaccaaaagggttacagggaggccctctgcaagtggatcgacttcactagggacttcctgtccaagtacaccaagactacctctatcgacctgtccagcctccgcccgtcgtcccagtacaaagatttgggcgagtattacgcggagctgaacccactgctctaccacatcagcttccagcgcatcgcggagaaggagatcatggacgcagtggagacgggcaagctatacctatttcagatatacaacaaagacttcgctaagggacaccacggcaagcctaacctgcacaccctctactggacggggctcttcagcccggagaacctcgccaagacctcgatcaagctcaacggccaggccgagctgttctaccggcccaagtcccgcatgaagcggatggcccaccggctcggggagaaaatgctcaacaagaaattgaaggaccaaaaaacgccgatacccgacaccctataccaggagctgtacgactatgtgaaccaccgcctgagccacgacctcagcgacgaggcgcgggccctcctgccgaacgtcatcacaaaggaggtcagccacgagatcatcaaggaccggcgcttcacctccgacaagtttttctttcacgtgcccatcacgctcaactaccaggccgccaactcgccgtccaagttcaaccagcgcgtgaacgcctacctcaaggagcaccccgagaccccgatcatcgggattgaccgaggggagcggaacctcatctacatcaccgtcatcgacagcaccgggaagatccttgaacagcggtcgctcaacaccatccagcagttcgactaccagaagaaactcgacaaccgggagaaggagagagtggcggcccgccaggcttggtccgtcgtcgggacgattaaggacttgaaacaaggttacctgtcgcaagtgatccacgagatcgttgacctgatgatccactaccaagccgtcgtggtcctggagaacctcaacttcggcttcaagagcaaacgaaccggcatcgcggagaaggccgtgtaccagcagttcgaaaaaatgctgatcgacaagctgaactgcctcgtgctcaaggactaccccgctgagaaggtcggcggggtgctgaacccgtaccagctcactgaccagttcaccagcttcgcaaagatgggcacccagtccggcttcctgttctacgtgcctgcgccatacacctcgaagatcgacccgctcaccgggttcgtggaccccttcgtctggaagaccatcaagaaccacgagagccgcaagcacttcctggagggcttcgacttcctccactacgacgtcaagaccggggacttcatcctgcacttcaagatgaaccgcaacctcagtttccagcgcggcctgccggggttcatgcccgcttgggatatagtcttcgagaagaatgagacgcagttcgacgcgaagggcaccccgttcatcgccgggaagcgcatcgtgccggtcatcgagaaccaccggttcaccgggcgctaccgcgacctatacccggcgaacgagttgatcgccctcctggaggagaagggcatcgtgttccgcgacggctccaacatcctcccgaagctgctcgaaaacgacgactcccacgccatcgacacgatggtcgcgctgatccggtcggtgctccagatgcggaactccaacgccgcgacgggcgaggactacatcaacagtccggtccgcgatctgaacggcgtctgcttcgactcccggttccagaaccccgagtggccgatggacgcggacgcgaacggcgcataccacatcgccctaaaagggcaattgctgctcaaccacctcaaggaatccaaagacctaaagctccagaacggcatctccaaccaggactggctggcgtacatccaggaactgcggaacgggagcaaaaaacgtcggatcaagcaagattga

SEQ ID NO: 20 - DNA, 3987 bp, Artificial
  enasCPf1
atggcgggctccaagaaacgccggattaagcaagatacccagttcgaggggttcacgaacctctaccaagtgagcaagaccctccgattcgaactgattcctcaggggaagaccctcaagcacatccaggagcaagggttcatcgaggaggacaaggcgcggaacgaccactacaaggaactcaaacccatcatcgaccgcatctacaagacctacgccgatcagtgcctccagctcgtgcagttggactgggagaacctcagcgcggccattgactcctaccggaaggagaaaacggaggagacgcgcaacgcgctcatcgaggaacaggcaacctatcgcaacgccatccacgactacttcatcgggaggactgacaacctcactgacgcgattaacaagcgccacgcggagatatacaagggactcttcaaagcggagctgtttaacggcaaggttctcaagcaactcggcactgtgaccacgaccgagcatgagaacgccctgctccgctccttcgacaagttcaccacctacttctccgggttctaccgcaaccgcaagaatgtcttcagcgcggaggacatcagcacggccattccacatcgaatcgtccaagataacttcccgaagttcaaggagaactgccacatcttcacccgactcattactgctgtaccgtcgttacgcgaacacttcgagaacgtcaagaaggcaattggaatcttcgtctctacgtcaatagaggaggtgttcagcttccctttctacaaccagctccttacgcagacccagatagacctgtacaatcagctcctcggtgggatcagccgggaggcggggactgagaagattaaagggctcaacgaggtcttgaacctggccatccaaaaaaacgatgagacggcgcacatcatcgcctcgctgccccaccggttcatcccgctgttcaagcagatcctcagtgacaggaacaccttgagctttatcctagaggagttcaagagcgacgaggaggtgatccagagcttctgcaagtacaaaaccctgctgaggaacgagaacgtcctggagacggcggaggcgctgttcaacgagctgaactctatcgacttaactcacatattcatctcgcacaagaagctggagactattagctctgcactctgcgaccactgggacaccctccgcaacgcgctctacgagcgccgcatctcggagctgaccgggaagatcaccaaatccgcgaaggaaaaggtccagcgttccctcaaacacgaggatattaacttacaggagattatctcagcggctgggaaggagttgtcagaggcgttcaagcagaaaacttccgagatcctgagccacgcgcacgcagcgctcgaccagcctctgcccaccaccctcaaaaagcaggaagaaaaagagatcctcaagagccagttggactccctgctggggctctatcaccttctcgactggttcgccgtcgatgagtcgaacgaggtggaccccgagttctccgcccggctgaccggcatcaagctagagatggagccgtccctcagcttctacaataaggcccgcaactacgcgaccaaaaaaccctacagcgtggagaagttcaagctgaacttccagatgccgaccttagcacgcggttgggacgtaaacagggagaagaacaatggagccatcctgttcgtcaagaacgggctttactacctcgggataatgcccaagcagaagggccgctacaaggccctttccttcgagccgacggagaaaacctccgaggggttcgacaagatgtactacgactacttccccgacgccgccaagatgatcccgaagtgctcaacgcagctaaaagccgtgaccgcccacttccagacccacacgacgccgatcctgctgagcaacaacttcatcgagccccttgagatcactaaggagatatacgacctgaacaaccccgagaaggagcccaagaagtttcaaaccgcctacgccaaaaaaactggcgaccaaaagggctacagggaggcgctgtgtaagtggatcgacttcacacgcgacttcctttcgaagtatacgaagacaacctctattgacctgagcagcctgcgtcctagctcccagtacaaagatttgggcgagtactacgcggagcttaatccactactctaccacatctcattccagcgcatcgctgagaaggaaatcatggacgcggtggagacaggcaaactgtacctcttccagatatacaacaaagacttcgctaaggggcaccacgggaagcccaaccttcatacgctctactggacgggcctattcagccccgaaaatctggccaagacctccatcaagctgaacggccaagcggagctgttctacagacccaagagccggatgaagcggatggcccacaggctcggcgagaaaatgcttaacaaaaagttgaaggaccagaaaacccctatccccgacaccctctaccaggaactgtacgactacgtgaaccacaggctctcgcacgacctttccgacgaggcccgtgccctactcccgaacgtcattaccaaagaggtttcgcacgagatcatcaaggaccggcggttcacgagcgacaagtttttctttcacgtccccatcacccttaactaccaggcggccaactccccatccaagttcaaccagcgtgtgaatgcctacctcaaggagcacccagagaccccgatcattgggatcgaccggggcgagcggaacctgatctacatcaccgtcatcgactcgacgggcaagattcttgagcagagatcgttgaataccatacagcagttcgactaccagaagaaactcgacaaccgcgagaaggagcgcgtggcggcccgccaggcgtggtccgtcgttgggacgattaaggacttgaaacaaggttatctgtcccaagtcatccacgagatcgttgatctgatgatccactatcaggcagtggtggtgctggagaatctcaacttcggcttcaagagtaagcggacgggaatcgccgagaaggccgtgtaccagcagttcgagaagatgctgatcgacaagctcaactgccttgtgctgaaagactacccggccgagaaggtcggcggcgtcctcaacccgtaccaacttaccgaccagttcacctccttcgccaagatgggcactcagtccgggttcttgttctacgtccccgcaccttacacctctaagatcgaccctctgactggcttcgtagatccattcgtgtggaagaccattaagaaccacgagagccgcaagcacttcctggagggcttcgacttcctgcactacgacgtgaagaccggggacttcatccttcacttcaagatgaaccggaacctcagcttccagcggggcctgccggggttcatgcccgcctgggacatcgtgttcgagaagaacgagacccagttcgacgcgaagggcacgcccttcatcgccgggaagcgtatcgtgccggtgatcgagaaccatcgtttcacgggtcgctaccgtgacctctacccggcgaacgagcttatcgcactcctggaggagaagggcatcgtcttccgggacggctccaacatcctcccgaaactgctggaaaacgacgactctcacgccatcgacacgatggtggccctcatccggtccgtgctccaaatgcggaacagcaacgccgccaccggtgaggactacatcaacagcccggtccgggatctgaacggggtgtgcttcgattcgcggttccagaatcctgagtggccgatggacgcggatgcaaacggggcgtaccacatcgcgctcaagggccagttacttctgaaccaccttaaggagtctaaagatttgaaactccagaacgggatctcgaaccaggactggctggcctacatccaagagttgcggaacggcagcaagaagcggcggattaagcaagattag

SEQ ID NO: 21 - DNA, 1592 bp, Medicago truncatula
actgttaataatttttaaacgtcagcgcactaaaaaaacgaaaagacggacacgtgaaaataaaaaacacacactagtttatgacgcaatactattttacttatgatttgggtacattagacaaaaccgtgaaagagatgtatcagctatgaaacctgtatacttcaatacagagacttactcatatcggatacgtacgcacgaagtatcatattaattattttaatttttaataaatattttatcggatacttatgtgatactctacatatacacaaggatatttctaagatactttatagatacgtatcctagaaaaacatgaagagtaaaaaagtgagacaatgttgtaaaaattcattataaatgtatatgattcaattttagatatgcatcagtataattgattctcgatgaaacacttaaaattatatttcttgtggaagaacgtagcgagagaggtgattcagttagacaacattaaataaaattaatgttaagttcttttaatgatgtttctctcaatatcacatcatatgaaaatgtaatatgatttataagaaaatttttaaaaaatttattttaataatcacatgtactattttttaaaaattgtatcttttataataatacaataataaagagtaatcagtgttaatttttcttcaaatataagttttattataaatcattgttaacgtatcataagtcattaccgtatcgtatcttaatttttttttaaaaaccgctaattcacgtacccgtattgtattgtacccgcacctgtatcacaatcgatcttagttagaagaattgtctcgaggcggtgcaagacagcatataatagacgtggactctcttataccaaacgttgtcgtatcacaaagggttaggtaacaagtcacagtttgtccacgtgtcacgttttaattggaagaggtgccgttggcgtaatataacagccaatcgatttttgctataaaagcaaatcaggtaaactaaacttcttcattcttttcttccccatcgctacaaaaccggttcctttggaaaagagattcattcaaacctagcacccaattccgtttcaaggtataatctactttctattcttcgattattttattattattagctactatcgtttaatcgatcttttcttttgatccgtcaaatttaaattcaattagggttttgttcttttctttcatctgattgaaatccttctgaattgaaccgtttacttgattttactgtttattgtatgatttaatcctttgtttttcaaagacagtctttagattgtgattaggggttcatataaatttttagatttggatttttgtattgtatgattcaaaaaatacgtcctttaattagattagtacatggatattttttacccgatttattgattgtcagggagaatttgatgagcaagtttttttgatgtctgttgtaaattgaattgattataattgctgatctgctgcttccagttttcataacccatattcttttaaccttgttgtacacacaatgaaaaattggtgattgattcatttgtttttctttgttttggattatacagg

SEQ ID NO: 22 - DNA, 2000 bp, Zea mays
gtcgtgcccctctctagagataaagagcattgcatgtctaaagtataaaaaattaccacatatttttttgtcacacttatttgaagtgtagtttatctatctctatacatatatttaaacttcactctacaaataatatagtctataatactaaaataatattagtgttttagaggatcatataaataaactgctagacatggtctaaaggataattgaatattttgacaatctacagttttatctttttagtgtgcatgtgatctctctgttttttttgcaaatagcttgacctatataatacttcatccattttattagtacatccatttaggatttagggttgatggtttctatagactaatttttagtacatccattttattctttttagtctctaaattttttaaaactaaaactctattttagttttttatttaataatttagatataaaatgaaataaaataaattgactacaaataaaacaaataccctttaagaaataaaaaaactaagcaaacatttttcttgtttcgagtagataatgacaggctgttcaacgccgtcgacgagtctaacggacaccaaccagcgaaccagcagcgtcgcgtcgggccaagcgaagcagacggcacggcatctctgtagctgcctctggacccctctcgagagttccgctccaccgttggacttgctccgctgtcggcatccagaaattgcgtggcggagcggcagacgtgaggcggcacggcaggcggcctcttcctcctctcacggcaccggcagctacgggggattcctttcccaccgctccttcgctttcccttcctcgcccgccgtaataaatagacaccccctccacaccctctttccccaacctcgtgttcgttcggagcgcacacacacgcaaccagatctcccccaaatccagccgtcggcacctccgcttcaaggtacgccgctcatcctccccccccccctctctctaccttctctagatcggcgatccggtccatggttagggcccggtagttctacttctgttcatgtttgtgttagagcaaacatgttcatgttcatgtttgtgatgatgtggtctggttgggcggtcgttctagatcggagtaggatactgtttcaagctacctggtggatttattaattttgtatctgtatgtgtgtgccatacatcttcatagttacgagtttaagatgatggatggaaatatcgatctaggataggtatacatgttgatgcgggttttactgatgcatatacagagatgctttttttctcgcttggttgtgatgatatggtctggttgggcggtcgttctagatcggagtagaatactgtttcaaactacctggtggatttattaaaggataaagggtcgttctagatcggagtagaatactgtttcaaactacctggtggatttattaaaggatctgtatgtatgtgcctacatcttcatagttacgagtttaagatgatggatggaaatatcgatctaggataggtatacatgttgatgcgggttttactgatgcatatacagagatgctttttttcgcttggttgtgatgatgtggtctggttgggcggtcgttctagatcggagtagaatactgtttcaaactacctggtggatttattaattttgtatctttatgtgtgtgccatacatcttcatagttacgagtttaagatgatggatggaaatattgatctaggataggtatacatgttgatgtgggttttactgatgcatatacatgatggcatatgcggcatctattcatatgctctaaccttgagtacctatctattataataaacaagtatgttttataattattttgatcttgatatacttggatgatggcatatgcagcagctatatgtggattttttagccctgccttcatacgctatttatttgcttggtactgtttcttttgtccgatgctcaccctgttgtttggtgatacttc

SEQ ID NO: 23 - protein, 228 aa, Rattus norvegicus
SSETGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPHVTLFIYIARLYHHADPRNRQGLRDLISSGVTIQIMTEQESGYCWRNFVNYSPSNEAHWPRYPHLWVRLYVLELYCIILGLPPCLNILRRKQPQLTFFTIALQSCHYQRLPPHILWATGLK

SEQ ID NO: 24 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 25 - DNA, 621 bp, Petromyzon marinus
acagatgcagagtatgtgagaattcacgaaaagctggacatctataccttcaagaagcagttctttaacaataagaagtctgtgagccataggtgctacgtgctgttcgagctgaagagaaggggtgaaagaagggcatgtttttgggggtatgctgtgaacaagccccagtctggaactgagagaggcattcacgccgaaattttcagcatcagaaaggtggaggaatacctgagggataaccctggacagtttacaattaattggtattctagctggtctccatgcgctgactgtgccgagaagatcctggaatggtacaaccaggagctgagaggaaatggccataccctgaagatttgggcctgcaagctgtactatgaaaagaacgcaagaaatcagatcggactgtggaacctgagggataatggtgtggggctgaacgtgatggtgtccgagcactatcagtgctgtagaaagattttcattcagtcctcacataatcagctgaacgagaatagatggctggaaaagactctgaagagggctgagaagagaaggtccgaactgtcaattatgatccaggtgaagatcctgcacaccactaagtcacctgccgtg

SEQ ID NO: 26 - protein, 160 aa, Artificial
  deaminase
FERNYDPRELRKETYLLYEIKWGKSGKLWRHWCQNNRTQHAEVYFLENIFNARRFNPSTHCSITWYLSWSPCAECSQKIVDFLKEHPNVLEIYVARLYYHEDERNRQGLRDLVNSGVTIRIMDLPDYNYCWKTFVSDQGGDEDYWPGHFAPWIKQYSLKL

SEQ ID NO: 27 - protein, 207 aa, Artificial
  deaminase
TDAEYVRIHEKLDIYTFKKQFSNNKKSVSHRCYVLFELKRRGERRACFWGYAVNKPQSGTERGIHAEIFSIRKVEEYLRDNPGQFTINWYSSWSPCADCAEKILEWYNQELRGNGHTLKIWVCKLYYEKNARNQIGLWNLRDNGVGLNVMVSEHYQCCRKIFIQSSHNQLNENRWLEKTLKRAEKRRSELSIMFQVKILHTTKSPAV

SEQ ID NO: 28 - protein, 228 aa, Artificial
  deaminase
SSKTGPVAVDPTLRRRIEPHEFEVFFDPRELRKETCLLYEINWGGRHSIWRHTSQNTNKHVEVNFIEKFTTERYFCPNTRCSITWFLSWSPCGECSRAITEFLSRYPNVTLFIYIARLYHLANPRNRQGLRDLISSGVTIQIMTEQESGYCWHNFVNYSPSNESHWPRYPHLWVRLYVLELYCIILGLPPCLNILRRKQSQLTSFTIALQSCHYQRLPPHILWATGLK

SEQ ID NO: 29 - protein, 162 aa, Artificial
  deaminase
SFERNYDPRELRKETYLLYEIKWGKSGKLWRHWCQNNRTQHAEVYFLENIFNARRFNPSTHCSITWYLSWSPCAECSQKIVDFLKEHPNVNLEIYVARLYYPENERNRQGLRDLVNSGVTIRIMDLPDYNYCWKTFVSDQGGDEDYWPGHFAPWIKQYSLKL

SEQ ID NO: 30 - protein, 166 aa, Escherichia coli
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 31 - protein, 166 aa, Artificial
  deaminase
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 32 - protein, 166 aa, Artificial
  deaminase
SEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 33 - protein, 166 aa, Artificial
  deaminase
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTD

SEQ ID NO: 34 - protein, 166 aa, Artificial
  deaminase
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTD

SEQ ID NO: 35 - protein, 83 aa, Bacillus phage AR9
TNLSDIIEKETGKQLVIQESILMLPEEVEEVIGNKPESDILVHTAYDESTDENVMLLTSDAPEYKPWALVIQDSNGENKIKML

SEQ ID NO: 36 - protein, 19 aa, Artificial
  Spacer
NNNNNNNNNNNNNNNNNNN

SEQ ID NO: 37 - protein, 22 aa, Artificial
  Target strand
AAANNNNNNNNNNNNNNNNNNN

SEQ ID NO: 38 - protein, 22 aa, Artificial
  Non-target strand
TTTNNNNNNNNNNNNNNNNNNN

SEQ ID NO: 39 - protein, 24 aa, Artificial
  peptide tag
EELLSKNYHLENEVARLKKGSGSG

SEQ ID NO: 40 - protein, 241 aa, Artificial
  peptide tag
EEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSGEELLSKNYHLENEVARLKKGSGSG

SEQ ID NO: 41 - protein, 277 aa, Unknown
  peptide tag
MGPDIVMTQSPSSLSASVGDRVTITCRSSTGAVTTSNYASWVQEKPGKLFKGLIGGTNNRAPGVPSRFSGSLIGDKATLTISSLQPEDFATYFCALWYSNHWVFGQGTKVELKRGGGGSGGGGSGGGGSSGGGSEVKLLESGGGLVQPGGSLKLSCAVSGFSLTDYGVNWVRQAPGRGLEWIGVIWGDGITDYNSALKDRFIISKDNGKNTVYLQMSKVRSDDTALYYCVTGLFDYWGQGTLVTVSSYPYDVPDYAGGGGGSGGGGSGGGGSGGGGS

SEQ ID NO: 42 - DNA, 66 bp, Unknown
  recruiting motif
ttcttgtcgtacttatagatcgctacgttatttcaattttgaaaatctgagtcctgggagtgcgga

SEQ ID NO: 43 - protein, 605 aa, Unknown
  recruiting motif
MSGWESYYKTEGDEEAEEEQEENLEASGDYKYSGRDSLIFLVDASKAMFESQSEDELTPFDMSIQCIQSVYISKIISSDRDLLAWFYGTEKDKNSVNFKIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPLKEACRAYGLKSGLKKQELLEALTKHFQD

SEQ ID NO: 44 - protein, 482 aa, Unknown
  recruiting motif
MVRSGNKAAWLCMDVGFTMSNSIPGIESPFEQAKKVITMFVQRQVFAENKDEIALVLFGTDGTDNPLSGGDQYQNITVHRHLMLPDFDLLEDIESKIQPGSQQADFLDALIVSMDVIQHETIGKKFEKRHIEIFTDLSSRFSKSQLDIIIHSLKKCDISERHSIHWPCRLTIGSNLSIRIAAYKSILQERVKKTTWDAKTLKKEDIQKETVYCLNDDDETEVLKEDIIQGFRYGSDIVPFSKVDEEQMKYKSEGKCFSVLGFCKSSQVQRRFFMGNQVLKVFAARDDEAAAVALSSLIHALDDLDIWAIVRYAYDKRANPQVGVAFPHIKHNYECLVYVQLPFMEDLRQYMFSSLKNSKKYAPTEAQLNAVDALIDSMSLAKKDEKTDTLEDLFPTTKIPNPRFQRLFQCLLHRALHPREPLPPIQQHIWNMLNPPAEVTTKSQIPLSKIKTLFPLIEAKKKDQVTAQEIFQDNHEDGPTAK

SEQ ID NO: 45 - DNA, 10 bp, Unknown
  recruiting motif
aatttttgga

SEQ ID NO: 46 - protein, 83 aa, Unknown
  archaea
GSVIDVSSQRVNVQRPLDALGNSLNSPVIIKLKGDREFRGVLKSFDLHMNLVLNDAEELEDGEVTRRLGTVLIRGDNIVYISP

SEQ ID NO: 47 - DNA, 25 bp, MS2 phage
gcgcacatgaggatcacccatgtgc

SEQ ID NO: 48 - protein, 116 aa, MS2 phage
MASNFTQFVLVDNGGTGDVTVAPSNFANGIAEISSNSRSQAYKVTCSVRQSSAQNRKYTIKVEVPKGAWRSYLNMELTIPIFATNSDCELIVKAMQGLLKDGNPIPSAIAANSGIY

SEQ ID NO: 49 - DNA, 26 bp, PP7 phage
ataaggagtttatatggaaaccctta

SEQ ID NO: 50 - protein, 127 aa, PP7 phage
MSKTIVLSVGEATRTLTEIQSTADRQIFEEKVGPLVGRLRLTASLRQNGAKTAYRVNLKLDQADWDCSTSVCGELPKVRYTQVWSHDVTIVANSTEASRKSLYDLTKSLVATSQVEDLVVNLVPLGR

SEQ ID NO: 51 - DNA, 19 bp, Unknown
  recruiting motif
ctgaatgcctgcgagcatc

SEQ ID NO: 52 - protein, 62 aa, Unknown
  recruiting motif
MKSIRCKNCNKLLFKADSFDHIEIRCPRCKRHIIMLNACEHPTEKHCGKREKITHSDETVRY

SEQ ID NO: 53 - protein, 1367 aa, Artificial
  nCas9
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 54 - protein, 1367 aa, Artificial
  enCas9
DKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLADDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPALESEFVYGDYKVYDVRKMIAKSEQEIGKATAKYFFYSNIMNFFKTEITLANGEIRKAPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 55 - DNA, 4101 bp, Unknown
  Cas9
gacaagaagtacagcatcgggctggcgatcgggaccaactccgtcggctgggctgtgattaccgacgagtacaaggtgccatccaagaagttcaaggtcctcggcaacactgaccggcacagcattaagaagaacctgattggggcgctgctgttcgattcgggggagactgcggaggcgaccaggctgaagcggactgcgcgccggaggtacaccaggaggaagaatcggatctgctacctccaggagattttctcgaatgagatggccaaggtggacgattccttcttccatcgcctggaggagtcgttcctcgttgaggaggacaagaagcatgagaggcatcccattttcgggaatatcgttgacgaggtggcttaccatgagaagtacccgaccatctaccatctgcggaagaagctcgtcgattcgaccgataaggccgacctgcggctgatctacctggccctcgcgcacatgattaagttccggggccatttcctcatcgagggcgacctcaacccggacaactcggacgtggataagctcttcattcagctcgtgcagacatacaaccagctcttcgaggagaatcccattaacgcctcgggggtcgacgctaaggctattctctcggctcggctgtcgaagtcgcgccggctggagaatctcattgcccagctcccaggcgagaagaagaacggcctcttcggcaacctgattgccctgtcgctggggctcacaccgaatttcaagtcgaacttcgacctcgccgaggacgctaagctccagctcagcaaggatacttacgatgatgacctcgataacctgctcgcccagattggggatcagtacgcggatctgttcctcgcggccaagaatctcagcgatgctattctcctgtcggacattctccgcgtcaacacagagattactaaggccccactgtcggcgagcatgattaagaggtacgatgagcatcatcaggacctgacactgctcaaggcgctggtccggcagcagctccccgagaagtacaaggagattttcttcgatcagtcaaagaatgggtacgcgggctacattgatggcggcgcgtcccaggaggagttctacaagttcattaagcccatcctggagaagatggacgggaccgaggagctgctggtgaagctcaatcgggaggacctgctccggaagcagcgcacattcgacaatggctcgattcctcaccagattcacctgggcgagctgcacgccattctccgcaggcaggaggacttctacccgttcctcaaggacaaccgcgagaagatcgagaagatcctgaccttccggattccatactacgtggggccgctcgcgcgggggaactcccggttcgcgtggatgactcgcaagtccgaagaaacgattacaccgtggaatttcgaggaggtcgtcgacaagggcgctagtgcgcagtcattcattgagaggatgaccaatttcgataagaacctgcctaacgagaaggtgctgccgaagcattcgctgctctacgagtacttcaccgtttacaatgagctgaccaaggtgaagtatgtgactgagggcatgaggaagccagcgttcctgagcggcgagcagaagaaggctatcgtggacctgctcttcaagactaaccggaaggtgactgtgaagcagctcaaggaggactacttcaagaagattgagtgcttcgattccgttgagattagcggggtggaggatcggttcaatgcttcgctcgggacataccacgatctcctgaagatcattaaggataaggacttcctcgacaacgaggagaacgaggacattctcgaagatattgtcctgaccctcaccctcttcgaggatcgggagatgatcgaggagaggctcaagacatacgctcatctgttcgatgataaggtcatgaagcagctgaagcgcaggcggtacacagggtgggggcggctgagccggaagctgatcaacgggattcgggataagcagtccgggaagacaattctcgacttcctcaagtccgacgggttcgctaaccggaacttcatgcagctcattcatgatgactcgctgacattcaaggaggatattcagaaggcgcaggtttcggggcagggcgactcgctccacgagcatattgcgaatctggcgggctcccccgcgattaagaagggcattctgcaaaccgtcaaggtggttgatgagctggtcaaggtcatggggcggcataagccagagaatattgtcatcgagatggcgcgggagaatcagaccacacagaaggggcagaagaactcacgggagcggatgaagcgcatcgaggagggcatcaaggagctggggtcgcagatcctgaaggagcatcccgtggagaacactcagctgcaaaatgagaagctgtacctctactacctccagaacgggagggacatgtatgtggatcaggagctggatattaataggctgagcgattacgatgtcgaccacattgtcccacagtcgttcctgaaggacgacagcattgacaacaaggtgctgacccgctcggataagaacaggggcaagagcgataatgttccaagcgaggaggttgtgaagaagatgaagaactactggcggcagctcctgaacgcgaagctcatcacacagcggaagttcgacaacctcaccaaggctgagcgcgggggcctgagcgagctggacaaggcggggttcattaagaggcagctggtcgagacacggcagattacaaagcatgttgcgcagattctcgattcccggatgaacaccaagtacgatgagaacgataagctgattcgggaggtcaaggtaattaccctgaagtccaagctggtgtccgacttcaggaaggacttccagttctacaaggttcgggagatcaacaactaccaccacgcgcatgatgcctacctcaacgcggtcgtggggaccgctctcatcaagaagtacccaaagctggagtcagagttcgtctacggggattacaaggtttacgacgtgcggaagatgatcgctaagagcgagcaggagattggcaaggctaccgctaagtacttcttctactccaacatcatgaacttcttcaagacagagattaccctcgcgaatggcgagatccggaagaggcccctcatcgagacaaatggggagacaggggagattgtctgggataaggggcgggatttcgcgaccgtccggaaggtcctgtcgatgccccaggttaatattgtcaagaagactgaggtccagactggcggcttctcaaaggagtcgattctcccaaagaggaactccgataagctcattgctcggaagaaggattgggaccccaagaagtacgggggattcgactcccccactgttgcttactctgttctggttgttgctaaggtggagaaggggaagtcgaagaagctgaagagcgtgaaggagctgctcgggattacaattatggagaggtcatccttcgagaagaatcccatcgacttcctggaggccaagggctacaaggaggtgaagaaggacctgattattaagctgcccaagtactcgctcttcgagctggagaatgggcggaagcggatgctggcgtccgcgggggagctgcaaaaggggaacgagctggcgctcccctccaagtatgtgaacttcctctacctggcgtcgcactacgagaagctgaaggggtccccagaggataatgagcagaagcagctcttcgtcgagcagcataagcactacctggacgagattatcgagcagattagcgagttctcgaagcgggtcatcctcgcggatgcgaacctggataaggtgctcagcgcctacaataagcaccgggacaagccgattcgggagcaggcggagaatattattcacctcttcacactcaccaacctcggggcaccagctgcgttcaagtacttcgacactactatcgaccggaagcggtacacctcgacgaaggaggtgctcgacgccaccctcattcaccagtcgatcacaggcctgtacgagacacggattgacctgtcccagctcgggggcgac

SEQ ID NO: 56 - DNA, 4101 bp, Unknown
  Cas9
gacaagaagtactccattggcctggcgattgggacaaactcggtggggtgggccgtgattacggatgagtacaaggttccaagcaagaagttcaaggtcctcgggaacacagatcggcattcgattaagaagaatctcattggggcgctcctcttcgactcgggggagacagcggaggctaccaggctcaagcggacagccaggcggcggtacacaaggcggaagaatcgcatctgctacctccaggagattttctcgaatgagatggcgaaggtggacgacagcttcttccatcggctggaggagtccttcctggtggaggaggataagaagcacgagaggcatccaattttcgggaacatcgtggacgaggttgcgtaccatgagaagtaccctacaatctaccatctgcggaagaagctggttgactccacagacaaggcggacctgaggctgatctacctcgctctggcccacatgattaagttccgcgggcatttcctgatcgagggggacctgaatcccgacaattcggatgtggacaagctcttcatccagctggtgcagacctacaaccagctgttcgaggagaatcccatcaatgcgtcgggcgttgacgctaaggccattctgtccgctaggctgtcgaagagcaggaggctggagaacctgatcgcccagctgccaggcgagaagaagaatgggctcttcgggaatctgattgcgctctccctggggctgacaccgaacttcaagagcaatttcgatctggctgaggacgcgaagctccagctctcgaaggacacttacgacgatgacctcgataacctcctcgcgcagatcggggaccagtacgctgatctcttcctcgccgctaagaacctctcggatgctatcctgctctccgacattctccgggttaataccgagattacaaaggccccactgtcggcgtccatgatcaagcggtacgatgagcatcatcaggatctcaccctgctcaaggccctcgtgcggcagcagctgcccgagaagtacaaggagattttcttcgaccagagcaagaatgggtacgctggctacattgacggcggggcctcacaggaggagttctacaagttcatcaagccaatcctggagaagatggatgggacagaggagctgctggtgaagctcaaccgggaggatctgctcaggaagcagcggacgttcgacaacgggtcgattccccatcagatccacctgggggagctgcacgcgatcctgcgccggcaggaggatttctaccctttcctgaaggataatcgggagaagatcgagaagattctcaccttccggattccctactacgtcgggccactcgcgcggggcaatagcaggttcgcctggatgacacggaagagcgaggagacaatcaccccctggaacttcgaggaggttgtcgacaagggggcgtccgcccagtcattcattgagcggatgaccaatttcgacaagaatctgccaaatgagaaggttctcccaaagcatagcctcctctacgagtacttcactgtttacaacgagctgaccaaggtgaagtatgtgaccgagggcatgcggaagcccgcgttcctgtccggcgagcagaagaaggccattgtggacctcctgttcaagaccaatcgcaaggtcacagtcaagcagctcaaggaggattacttcaagaagatcgagtgcttcgactcggttgagattagcggggtggaggatcggttcaacgcgagcctcggcacttaccacgacctcctgaagatcatcaaggataaggacttcctcgacaacgaggagaacgaggatattctggaggacatcgtgctcaccctgacgctgttcgaggatcgggagatgatcgaggagcgcctgaagacctacgctcatctcttcgatgataaggtcatgaagcagctgaagaggaggcggtacaccgggtggggccgcctgagcaggaagctcattaacgggatcagggacaagcagagcggcaagaccatcctggacttcctcaagagcgatggcttcgccaaccggaatttcatgcagctcatccacgacgactccctcaccttcaaggaggacattcagaaggctcaggtcagcggccagggcgactcgctgcatgagcacatcgctaacctggcgggcagcccagccatcaagaagggcatcctccagacagtgaaggtcgtggatgagctggtgaaggtcatgggccggcataagcccgagaatattgtgattgagatggcgcgggagaatcagaccactcagaagggccagaagaactcgcgggagcgcatgaagaggatcgaggaggggattaaggagctgggcagccagattctcaaggagcaccccgtggagaatacccagctccagaacgagaagctgtacctctactacctccagaatgggcgggacatgtatgttgatcaggagctggacatcaatcgcctctcggattacgacgtggaccacatcgtgccccagagcttcctgaaggatgatagcatcgacaataaggtcctgacccgctccgacaagaatcgcggcaagagcgacaacgtgccgagcgaggaggtcgtgaagaagatgaagaactactggcggcagctgctgaacgcgaagctcattacacagcggaagttcgataacctgacgaaggcggagaggggcggcctctccgagctggacaaggcgggcttcattaagaggcagctcgtggagactcgccagatcaccaagcacgtggctcagatcctcgatagccggatgaatacgaagtacgatgagaatgacaagctcatccgggaggtgaaggtaatcaccctgaagtcaaagctcgttagcgatttccggaaggacttccagttctacaaggtgcgggagattaacaactaccatcatgcgcacgatgcgtacctcaatgcggtggtgggcacagccctgattaagaagtaccccaagctggagagcgagttcgtctacggggactacaaggtgtacgatgttcggaagatgatcgccaagagcgagcaggagattgggaaggccaccgctaagtacttcttctactcgaatattatgaatttcttcaagaccgagatcacactcgctaatggggagattcggaagcggcccctcatcgagactaacggggagactggcgagattgtgtgggacaaggggcgcgacttcgctaccgtgcgcaaggtcctctcgatgccccaggttaatattgttaagaagacagaggtgcagacgggcgggttctccaaggagtctatcctgccgaagcggaactcggacaagctgatcgcccgcaagaaggattgggaccccaagaagtacgggggattcgatagcccaaccgtggcttacagcgtcctggtggtcgccaaggttgagaaggggaagtcgaagaagctcaagagcgttaaggagctgctgggcatcaccatcatggagcggtccagcttcgagaagaatcctatcgacttcctggaggctaaggggtacaaggaggtcaagaaggacctgatcattaagctgcccaagtactctctgttcgagctggagaacgggaggaagcggatgctggcgtctgctggcgagctacagaagggcaatgagctggcgctcccctcgaagtatgtcaacttcctctacctggcttcccattacgagaagctgaagggctcgcccgaggataatgagcagaagcagctcttcgtggagcagcacaagcactacctcgacgagatcattgagcagatttcggagttctcgaagcgggtcattctcgcggacgcgaacctcgacaaggtcctctcggcgtacaacaagcaccgggacaagcccatccgggagcaggccgagaacattatccacctcttcacactgaccaacctcggcgctcccgccgcgttcaagtacttcgacaccaccattgaccgcaagagatacacatccaccaaggaggtgctggacgcgaccctcatccaccagagcatcacaggcctctacgagacacggatcgacctctcgcagctcgggggcgat

SEQ ID NO: 57 - DNA, 4092 bp, Unknown
  Cas9
gacaagaagtactcgatcggcctggcgattggcacaaacagcgtggggtgggctgtgatcactgatgagtacaaggtgccatcgaagaagttcaaggtgctggggaatacagaccggcattcgatcaagaagaatctcattggcgctctcctcttcgattccggcgagactgctgaggcgacccgcctgaagcgcaccgcccggcggcgctacactcggcggaagaataggatttgctacctccaggagattttctcgaatgagatggccaaggtggatgacagcttcttccaccgcctggaggagtcgttcctggtcgaggaggacaagaagcatgagcggcaccctatcttcgggaatatcgttgatgaggtcgcctaccacgagaagtaccccactatctaccatctccgcaagaagctcgtggacagcacagataaggccgacctccgcctgatctacctcgccctcgcgcacatgattaagttccgggggcacttcctcattgagggggatctgaatcccgataactccgacgtggacaagctgttcatccagctggtgcagacatacaaccagctgttcgaggagaatcccatcaacgcgagcggcgtggacgctaaggccattctgtcggctaggctctcgaagtcgaggcggctggagaacctgattgcgcagctccccggcgagaagaagaacgggctgttcgggaatctcatcgccctctccctcggcctcacaccaaacttcaagagcaatttcgacctggctgaggacgctaagctgcaactctcaaaggatacatacgatgacgacctggacaatctcctggctcagatcggcgaccagtacgctgacctgttcctcgcggccaagaatctgtcggacgcgattctcctcagcgacatcctgcgcgtcaataccgagattacgaaggctccactgtctgcgtcaatgattaagcggtacgatgagcatcaccaggatctgaccctcctgaaggcgctcgtgcggcagcagctgcccgagaagtacaaggagattttcttcgatcagagcaagaatggctacgccggctacatcgacgggggcgcgagccaggaggagttctacaagttcatcaagcccatcctggagaagatggacggcaccgaggagctactcgtgaagctcaatcgggaggatctcctccggaagcagcggacattcgataacgggtctatcccacaccagatccacctcggcgagctgcatgcgattctgcggcggcaggaggatttctaccctttcctgaaggacaaccgggagaagatcgagaagatcctcacattccggattccatactacgtcggccccctggcgaggggcaatagccggttcgcgtggatgacaaggaagtccgaggagactattaccccgtggaatttcgaggaggtggttgacaagggcgcttccgcgcagagcttcattgagcggatgacaaacttcgacaagaatctccccaacgagaaggtcctgccgaagcatagcctcctgtacgagtacttcaccgtctacaatgagctaactaaggtcaagtatgtgacagagggcatgaggaagccagccttcctctcaggcgagcagaagaaggccattgtggacctcctgttcaagacaaaccgcaaggtgacagtgaagcagctgaaggaggattacttcaagaagattgagtgcttcgactcagtggagatttcaggcgtggaggatcggttcaacgcgagcctggggacttaccacgacctgctgaagattattaaggacaaggacttcctggataacgaggagaatgaggacatcctggaggatattgtgctcaccctcaccctgttcgaggacagggagatgattgaggagaggctcaagacctacgcgcacctgttcgatgacaaggtcatgaagcagctgaagaggcggcgctacactgggtggggccgcctgtcgcggaagctgatcaacggcattcgggataagcagtccgggaagaccattctggatttcctgaagtcggacggcttcgccaacaggaatttcatgcagctgatccacgacgactccctcaccttcaaggaggacattcagaaggcccaggttagcggccagggggactcactccacgagcatattgccaatctggccggctctccagctatcaagaagggcatcctgcaaacagttaaggttgttgacgagctggttaaggtcatggggcggcataagcccgagaacattgtcatcgagatggctcgggagaaccagacaactcagaagggccagaagaactccagggagcgcatgaagcggattgaggagggcattaaggagctggggtcccagatcctcaaggagcaccctgtcgagaacactcagctgcaaaacgagaagctctacctgtactacctccagaacgggcgggatatgtatgtggatcaggagctggacatcaacaggctctccgactacgacgtggatcacattgtcccacagtctttcctcaaggatgattccatcgacaacaaggtgctgacgcgcagcgacaagaatagggggaagtcggacaacgttccgagcgaggaggtcgtgaagaagatgaagaattactggaggcagctcctgaatgcgaagctgatcactcagaggaagttcgacaatctgacaaaggcggagaggggcgggctctcggagctggataaggcgggcttcatcaagcggcagctcgttgaaacccggcagatcaccaagcatgtcgcccagatcctcgatagccgcatgaacaccaagtacgatgagaacgacaagctcattcgggaggttaaggtcattacgctgaagtccaagctcgtcagcgacttcaggaaggatttccagttctacaaggttcgggagattaacaactaccaccacgcgcatgatgcgtacctgaacgctgttgtcggcactgctctcatcaagaagtacccaaagctggagtccgagttcgtctacggggactacaaggtctacgatgtccggaagatgatcgccaagtcggagcaggagatcgggaaggctactgcgaagtacttcttctacagcaacattatgaatttcttcaagacggagattacgctggcgaacggggagattaggaagaggcccctcattgagactaatggggagacaggcgagattgtttgggacaagggccgcgacttcgcgactgtgcggaaggtcctgtccatgccacaggtgaatattgttaagaagacagaggtgcagactgggggcttctcgaaggagagcattctcccaaagcggaacagcgataagctcatcgcgcgcaagaaggattgggaccctaagaagtacggcggcttcgattctcccactgtggcctactccgttctcgtggttgccaaggttgagaaggggaagtcgaagaagctgaagtcggtcaaggagctgctcgggattacaatcatggagcggagcagcttcgagaagaaccctattgatttcctggaggccaagggctacaaggaggttaagaaggatctcattatcaagctccctaagtactctctgttcgagctggagaatggccggaagaggatgctggcctcggctggcgagctacagaaggggaatgagctggccctcccgtcgaagtatgtgaatttcctgtacctcgcgtcgcactacgagaagctcaagggcagcccggaggataatgagcagaagcagctcttcgtggagcagcataagcactacctggacgagatcattgagcagatcagcgagttctcgaagcgggttattctggctgatgctaacctggacaaggttctgagcgcctacaataagcatcgcgacaagccgattcgcgagcaggcggagaatattatccacctgttcaccctcactaacctcggggctcccgcggccttcaagtacttcgataccacaatagataggaagcggtacacctcgacgaaggaggtcctcgacgccacactcatccatcagtcgattacaggcctgtacgagacacggattgacctctcgcagctg

SEQ ID NO: 58 - DNA, 4101 bp, Unknown
  Cas9
gacaagaagtattccataggcctggctatcggcaccaacagcgtgggctgggccgtcatcaccgacgagtacaaagtgccgagtaaaaagttcaaagtgctcggcaacaccgaccgccactccataaagaaaaacctgatcggggcgctcctgttcgacagcggcgagacggcggaggccacccgcttgaaacgcacggcccgacggcgctacacgcggcgcaagaaccggatctgttacctacaggagattttctctaacgagatggcgaaggtggacgactcgttctttcaccgcctcgaagagtccttcctcgtggaggaggacaagaaacacgagcgccacccgatcttcggcaacatcgtggacgaggtggcctaccacgagaagtacccgaccatctaccacctccggaagaaactcgtggacagcacggacaaggccgacctgaggctcatctacctcgccctggcgcacatgattaagttccggggccacttcctgatcgagggcgacctgaacccggacaacagcgacgtggacaagctgttcatccagctagtccagacctacaaccagcttttcgaggaaaaccccatcaacgccagcggggtggacgcgaaggcgatcctgtccgcccggctgagcaagtcccggcggctggagaacctcatcgcgcagttgcccggcgagaagaagaacgggctgttcgggaacctgatcgccctctccctggggctcaccccgaacttcaagtccaacttcgacctcgccgaggacgccaaactacagctgagcaaggacacctacgacgacgacctcgacaacctgctggcccagatcggggaccagtacgcagacctgttcctcgccgccaagaacctctccgacgccatcctgctgtcggacatcctgcgggtgaacacggagatcacgaaggccccgctctcggcctcgatgattaaacgctacgacgagcaccaccaggacttgaccctcctcaaggcgctggtccgccagcagcttcccgagaagtacaaggaaatctttttcgatcagagcaagaacgggtacgccgggtacatcgacggcggggcgtcccaggaggagttctacaagttcatcaagcccatcctggagaaaatggacgggaccgaggagctgctcgtgaagctcaaccgcgaagatttgctccgcaagcagcgcacgttcgacaacgggtcgatcccgcaccagatccacctgggcgagctgcacgcgatcctcaggcgtcaggaagacttctaccccttcctcaaggacaaccgcgagaagatagagaagattctgaccttcagaattccttattacgtgggcccgctggctcggggcaactcgcgcttcgcctggatgacgcgcaagtccgaggagaccatcaccccgtggaacttcgaggaggtggtggataagggtgcctcggcccagtccttcatcgagcggatgaccaacttcgacaagaacctgccgaacgagaaggtgctccccaagcacagcctgctctacgaatatttcacggtgtacaacgagctgacgaaggtcaagtacgtgaccgagggaatgaggaaacctgcattcctctccggggagcagaagaaagccatagtcgacctcctgttcaagaccaaccggaaggtcaccgtcaagcagctcaaggaggactacttcaagaagatcgagtgcttcgattcagtggagatcagcggcgtcgaggaccggttcaacgccagcctgggcacctaccacgacctgctcaagatcatcaaggacaaggacttcctcgacaacgaggagaacgaggacatcctggaggacatcgtgctgaccctgacgctcttcgaggaccgcgagatgatcgaggagcgcctcaagacctacgcccacctgttcgacgacaaggtgatgaagcagctcaagcggcggagatatactgggtggggccgcctctcccggaagctcattaacggtatcagggataagcagtccgggaagacgatcctcgacttcctcaagtcggacgggttcgccaaccgcaacttcatgcagctcatccacgacgactccctgacgttcaaggaggacatccagaaggcccaagtgtctggtcaaggtgactcgctccacgagcacatcgccaacctcgcgggcagcccggccatcaagaagggaatactccagaccgtcaaggtggtggacgagctggtgaaggtcatgggccgccacaagccggagaacatcgtcatcgagatggcgcgggagaaccagaccacgcagaaggggcagaaaaatagccgtgagcgcatgaagcgcatcgaggaggggattaaggagttgggcagccagatcctcaaggagcaccctgtggagaacacgcagttgcaaaacgagaagctctacctgtactacctccagaacgggagggatatgtacgtggaccaagaactggacatcaaccgcctgtccgactacgacgtggaccacatcgtgccgcagagcttcctcaaggacgacagcatcgacaacaaggtgctcacccggtccgacaagaatcggggcaagtccgacaacgtgcccagcgaggaggtcgtcaaaaagatgaaaaactactggcgacaactactgaacgccaagctcatcacccagcgcaagttcgacaacctcacaaaagccgagcgcggcgggttgagcgagctggacaaggccgggttcatcaagcgccagctcgtcgagacgcgccagatcacgaagcacgtcgcgcagatactcgacagccggatgaacaccaagtacgacgagaacgacaagctcatccgggaggtgaaggtcatcaccctcaagtcgaagctcgtgagcgacttccgcaaggacttccagttctacaaggtccgggagatcaacaactaccaccacgcccacgatgcttatcttaacgccgtggtggggacggccctcattaagaaatacccgaagctggagtcggagttcgtgtacggcgactacaaggtgtacgacgtcaggaagatgatcgccaagtccgaacaggagatcgggaaggccacggcgaaatacttcttctacagcaacatcatgaacttcttcaagaccgagatcaccctcgccaacggcgagatccgcaagcgcccgctcatcgagacgaacggggagaccggcgagatcgtctgggacaaggggcgcgacttcgccactgtgcggaaggtgctgtcgatgccccaggtcaacatcgtcaagaagacggaggtccagacgggcgggttcagcaaggagagcatcctgccgaagcgcaacagcgacaagctgatcgcccgcaaaaaggactgggatccaaaaaagtacggcggcttcgacagccccaccgtcgcctacagcgtcctcgtcgtcgctaaagtcgagaagggcaagtccaaaaagctcaagagcgtcaaggagctgctcgggatcaccatcatggagcggtccagcttcgagaagaacccaattgatttcctggaggcgaagggctacaaggaggtcaagaaagacctcatcataaagctgccgaagtactcactcttcgagctggagaacgggcgcaagcggatgctggcgtcggccggagagctccaaaagggcaacgagctggcgctgccgagcaagtacgtgaacttcctctacctggcgtcccactacgagaagctcaagggcagtccagaggataacgagcagaagcagctattcgtggagcagcacaagcactacctggacgagatcatcgagcagatcagcgagttctccaagcgcgtcatcctggcggacgccaacctggacaaggtgctgtccgcgtacaacaagcaccgcgacaagccgatccgcgagcaagccgagaacatcatccacctgttcaccctcacgaacctcggggcacccgccgccttcaaatatttcgacacgaccatcgaccgcaagcgctacaccagcacgaaggaggtgctcgacgccaccctgatccaccagagcatcaccgggctgtacgagacccgcatcgacctctcgcagctcggcggggac

SEQ ID NO: 59 - DNA, 4101 bp, Unknown
  Cas9
gacaagaagtacagtattggattggccatcgggacgaacagcgtgggctgggccgtcatcaccgacgagtacaaggtgccatccaagaagtttaaggttctggggaataccgaccgccactcgatcaagaaaaatctcatcggggcgctgcttttcgacagcggcgagacggcggaagcgacgcggctcaagcggacggctcgtcgccgttacacccggcgtaagaaccgcatctgttacctccaggagatattcagcaacgagatggcgaaggtggacgactcctttttccaccgtcttgaggagtccttcctggtcgaggaggacaagaagcacgagcgccacccgatcttcgggaacatcgtggacgaggtggcctaccacgagaagtaccccacgatctaccacctccgcaaaaaactcgtggactcaactgacaaggccgatttgaggcttatctacctcgccctcgcccacatgattaagttccgtgggcacttcctaatcgagggtgacctcaaccccgacaactctgacgtggacaagctgttcatccagcttgtgcagacctacaatcagctctttgaggagaatccgatcaacgcatctggtgtggacgcaaaggccatcctcagcgcgcggctgagcaagtctaggcggttggagaacctgatcgcccaactgcccggcgagaagaaaaatggcctcttcggcaacctgatcgccctgtcgctggggctcacgccgaacttcaagagtaactttgacctggcggaggacgctaagctccagctatctaaggacacatacgacgacgacctggacaacctgctggcccagatcggcgaccagtacgccgacctcttcctagccgccaagaacctgtccgacgccatcctcctcagcgacatcctgcgcgtgaacacggagatcacgaaggctccgctcagcgcctccatgattaagcggtacgacgagcaccaccaagacctaactttactcaaagccctcgtgcggcagcagcttcccgagaagtacaaagagatattttttgatcagtccaagaacggttatgcgggctacatcgacggcggcgcgagccaggaggagttctacaagttcatcaagcccatcctggagaagatggacggcacggaggagctgctcgtgaagctcaaccgtgaagacctcctgcgaaagcagcgaaccttcgacaacggttcgatcccgcaccagatccacctcggggagctgcacgccatcctgaggcgacaggaggacttctaccctttcctaaaggacaaccgcgagaagattgaaaaaatcctgacgtttcgcataccctactacgtcggcccgctggcgcgcggcaactcccggttcgcctggatgacccgtaagagcgaggagacgatcaccccgtggaacttcgaggaggtcgtggacaagggcgcgagcgcgcagagcttcatcgagcgcatgaccaacttcgacaagaacctcccgaacgagaaggtgctcccaaagcactccctcctgtacgagtatttcaccgtgtacaacgagttgacaaaggtgaagtacgtgacggagggaatgcggaagcctgcgttcctctcgggcgagcagaagaaggcaatcgtggacctgctcttcaagaccaaccggaaggtgacggtgaagcagctcaaggaggactacttcaaaaaaatcgagtgcttcgactccgtggagataagcggcgtggaggaccgattcaacgcctccctcggcacctaccacgacctccttaagatcatcaaggacaaggacttcctggacaacgaggagaacgaggacatcctggaggacatcgtgctcaccctgaccctcttcgaggaccgggagatgatcgaggagcgcctcaagacgtacgcccacttgttcgacgacaaggtgatgaagcagctcaagcggcggcgatacaccgggtggggccgcctatcccgcaaacttatcaacggcatccgcgacaagcagtccggcaagacgatcctggatttcctcaagtcggacgggttcgccaaccggaacttcatgcagctcatccacgacgacagcctcacgttcaaggaggacatccagaaggcccaagtgagcggtcaaggggacagcctccacgagcacattgcgaaccttgctgggagccctgcgatcaagaaggggatattgcaaaccgtgaaggtcgtggacgagttggtgaaggtcatggggcgacacaagcccgagaacatcgtgatcgagatggccagggaaaatcagaccacgcagaagggccaaaaaaacagccgcgagcggatgaagcggatcgaggagggcatcaaggagctggggtcgcagatcctcaaggagcacccggtggagaacacgcagctccagaacgagaagctgtacctctattacctacagaacgggcgggatatgtacgtggaccaggagctagacatcaaccgcctgtccgactacgacgtggaccatatcgtcccgcagtcgttcttgaaggacgacagcatcgacaacaaggtgctcacaagatcggataagaatcgaggcaagtccgacaacgtgccctcggaggaggtggtcaagaaaatgaaaaactactggcggcagttgctgaacgccaagctcattacgcagcggaagttcgacaacctgacgaaggctgaacgtggtgggctcagcgagctagacaaggcggggttcatcaagcggcagctcgtcgagacccggcagatcaccaagcacgtggcgcagatcctggactcgcgcatgaacaccaagtacgacgagaacgacaagctcatccgtgaggtgaaggtcatcacccttaagtctaagctggtcagtgacttccgcaaggacttccagttctacaaggtccgggagatcaacaactaccaccacgcgcacgacgcctacctcaacgcggtggtggggacggcgcttattaagaaatatcccaagctggaaagcgagttcgtttacggcgactacaaggtgtacgacgtccgcaagatgatcgcaaagtcggaacaggaaatcggaaaggcgacggccaaatatttcttttactccaacatcatgaatttttttaagacggagatcaccctggcgaacggggagatccgcaagcggcccctcatcgagaccaacggggagacgggcgagatcgtctgggacaagggccgggacttcgccaccgtgcggaaggtgctttctatgcctcaagtcaatatcgtcaaaaagacagaggtgcagaccggcgggttcagcaaggagtctatcctgccgaagcgcaactcggacaagctcatcgcgcgcaagaaagactgggaccccaaaaaatatggcgggttcgactcgccgaccgtcgcctacagcgtcctcgtggtggctaaggtcgagaagggcaagagcaaaaagctaaagtcggtgaaggagctgctgggcatcaccatcatggagcgctcgtctttcgagaagaatccaatcgacttcctagaggcgaaggggtacaaggaggtcaaaaaggatcttatcatcaaactgccgaagtacagtctgttcgagctggagaacgggcggaagcggatgctggctagtgcgggcgagttgcagaagggcaacgagttggcactgccctccaagtacgtgaacttcctgtacctggcctcccactacgagaagctcaaggggagccccgaggacaacgagcagaagcagctattcgtcgagcagcacaagcactacctggacgagatcatcgagcagatcagtgagttctccaagcgggtcatcctcgcggacgccaacctggacaaggtgctgagcgcgtacaacaagcacagggacaagccaatcagggaacaggccgagaacatcatccacctgttcaccctgaccaacctgggtgcaccggctgccttcaagtactttgacacgaccatcgaccggaagcgctacacctccacgaaggaggtgctggacgccacgctgatccaccagagcatcaccgggctctacgagacacggatcgacctgagccagcttggcggggac

SEQ ID NO: 60 - DNA, 4092 bp, Unknown
  Cas9
gacaaaaagtattccattggactcgctatcggcacgaacagcgtcgggtgggcggtcatcactgacgagtacaaggtgccgagcaagaagtttaaggtgctgggaaacaccgacaggcactcgatcaagaaaaatcttatcggggccctactcttcgactccggagaaaccgccgaggccacccggttgaagcgcacggcccgccgtcgctacaccaggcgcaagaaccggatctgctacctccaggagatattcagcaatgagatggcgaaggtggacgactcgttttttcacaggctagaggagtctttcctcgtggaggaggacaagaaacacgagcgccaccccatcttcggcaacatcgtggatgaggtggcatatcacgagaagtacccaaccatctaccacctccgcaaaaagctcgtggactctaccgacaaggccgacctccgtctgatctacctcgcgctggcccacatgattaagttccgaggacactttctgatcgagggcgacctgaacccagacaacagcgacgtggacaagctgttcatccaacttgtccagacctacaatcagctcttcgaggagaaccctatcaacgcctcgggcgtggacgcgaaggccatcctgtccgcccgcctgagcaagtcgcggcggctggagaacctgatcgcccagctccccggcgaaaaaaagaacggcctcttcggcaacctcatcgcgttgtcgctggggctcaccccgaacttcaagtccaacttcgacctggccgaggacgctaaactccagctctcgaaggatacctacgacgacgacctcgacaacctgctggcccagatcggcgaccagtacgcggaccttttcctggcggccaagaacctgagcgacgcgatcctccttagcgacatactccgtgtgaacaccgagatcacgaaggccccgctctccgcgtccatgattaagcgctacgacgagcaccaccaagaccttaccctgcttaaggcgctggtcaggcagcagttaccggagaagtacaaggagatcttttttgatcaatctaagaacggttacgccgggtacatcgacggcggcgcgtcccaggaggagttctacaagttcatcaagccgatcttggagaaaatggacgggaccgaggagctgctcgtgaagctcaaccgcgaagacctcctccgcaagcagcgcaccttcgacaacgggagcatcccgcaccagatccacctgggagagctgcacgcgatcctgcggagacaagaggacttctaccccttcctcaaggacaaccgggagaagattgaaaaaatacttacttttcgtatcccgtactacgtcgggccccttgcgaggggcaactccagattcgcgtggatgacccgcaagtccgaggagaccatcaccccgtggaacttcgaggaggtggtggacaagggcgcgtcggcccagtcgttcatcgagcgcatgaccaacttcgacaagaaccttccgaacgagaaggtgctcccgaagcacagcctgctctacgaatattttactgtgtacaacgagctgacgaaggtcaagtacgttacggaggggatgaggaagcccgccttcctctccggcgagcagaagaaagccattgtggatctcctgttcaagaccaaccgcaaggtgacggtgaaacagctcaaagaggactacttcaagaagatcgagtgcttcgactccgtagagatcagcggggtcgaggaccgcttcaacgcctcgctgggcacgtaccacgacctgctaaagattatcaaggacaaagacttcctagacaatgaggagaacgaggacattctggaggacatcgtgctgactctgacgctgttcgaagaccgcgagatgatcgaggagcggcttaagacgtacgcccacctgttcgacgacaaggtgatgaagcagttgaaacggcggcgctacaccgggtggggccgcctctcccgcaagctcatcaacggcatccgcgacaagcagtcggggaagacgatcctggacttcctcaagagcgacggcttcgccaaccgaaacttcatgcagctaatccacgacgacagcctgacgttcaaggaggacatccagaaggcccaagtgagcggccagggagactcgctacacgagcatatcgccaacctggctggcagcccggcgattaagaaaggaatcctccaaaccgtcaaagtggtggacgagctggtgaaggtgatgggccgccacaagcccgagaacattgtgatcgagatggcgcgggagaaccagacgacgcagaagggccaaaaaaatagcagggaaaggatgaagcgaatagaggaggggatcaaggagctggggagccagattctcaaagagcacccggtcgagaacacacagctccagaacgagaagctgtacctctactacctccaaaacggccgcgatatgtacgtggaccaggaactagacatcaaccggctgagcgactatgacgtggaccacatcgtgccgcagtccttcctcaaggacgactcgattgacaacaaagtgctcactagatccgacaagaacagaggcaagagcgataacgtcccgtcggaggaggtcgtcaagaaaatgaaaaactactggcggcagctcctaaacgccaagctcatcacgcagcgtaagttcgacaacctgacgaaggcggagcggggcgggctgagcgagctggacaaagcggggttcatcaagcggcagctcgttgagacgcggcagatcacaaagcacgtcgcgcaaatcctcgactcccgcatgaacaccaagtacgacgagaacgacaagctcatccgggaggtgaaggtcattacccttaaatcgaagctcgtcagcgactttcgtaaggacttccagttctacaaggtcagagagatcaacaactaccaccacgcccacgacgcctatctgaacgccgtggtgggcaccgcgcttattaagaagtaccccaagctggagtccgagttcgtgtacggcgactacaaggtttatgacgtcaggaagatgatcgccaagtcggaacaggagatcggaaaagctaccgccaaatatttcttctatagcaacatcatgaacttcttcaaaaccgagatcaccctcgccaacggcgagatccggaagcgcccgctcatcgagaccaacggggagaccggggagatcgtctgggacaaggggcgggacttcgctactgtccgaaaggtgctctccatgccacaagtgaatatcgtcaagaaaacagaggtgcagaccggagggttcagtaaggagtccatcctgcccaagcggaactccgacaagctaattgctcgcaaaaaggattgggatcctaaaaaatatggcggcttcgactcgcccacggtcgcctactctgtgctggtcgtggcgaaggtggagaagggcaagtccaagaagctcaagagcgtcaaggagctgctggggatcacgatcatggagcgtagttcgtttgagaagaatcccatcgacttcctggaggctaagggctacaaggaggtcaaaaaggacctcatcattaagctgccgaagtacagcctcttcgagctggagaacgggcggaagcgtatgctcgcctccgctggggagttacaaaaggggaacgagctggcgctgccgtctaagtacgtcaacttcctgtacctggcctcccactacgagaagctcaaggggtcgccggaggacaacgagcagaagcagctcttcgtagagcagcacaagcactacctggacgagatcatcgagcagatttcagagttctcaaagcgggtcatcctcgccgacgccaacctggacaaggtgctctcggcctacaacaagcaccgggacaagccgatccgcgaacaggccgaaaacatcatccacctgttcacgctcaccaacctcggtgccccggcggccttcaagtactttgacacgaccatcgaccggaagcgctatacctcgacgaaggaggtgctggacgccaccctgatccaccagtccatcaccgggctttacgagacccggatcgacctctcgcagcta

SEQ ID NO: 61 - DNA, 4101 bp, Unknown
  Cas9
gacaagaagtatagtattggactcgccatcggaaccaactctgtggggtgggctgttattacagatgaatataaggtgccatccaaaaagtttaaagttctgggcaatactgatagacactcaatcaagaagaatctgataggtgcacttctgtttgatagtggagagactgccgaggcaaccagacttaaaaggactgcaagaagaagatataccagaagaaagaataggatttgctatttgcaggaaatcttcagcaacgaaatggccaaggttgatgactcatttttccataggttggaggagagttttcttgtggaggaagataagaagcacgaaagacacccaattttcgggaatatagtggacgaggtggcttatcatgagaagtatcccactatctaccacctgagaaagaaacttgtggactcaaccgataaggctgatcttaggcttatatacttggcccttgcacatatgatcaaattcaggggccattttcttatcgaaggcgatcttaatcccgataactcagatgtggacaagctgtttatacaacttgtgcaaacctacaatcaactcttcgaggagaatcccattaacgcctccggcgtggatgcaaaagccatactgtcagccagactgagcaaaagtaggagactggagaatcttatagcccaactgcccggtgaaaagaagaatgggctcttcggaaatctgatcgctctttcattggggttgacacccaactttaagagtaactttgacttggcagaagatgcaaagttgcagctcagtaaagacacatatgacgatgaccttgacaatctcttggcacaaataggggatcaatacgctgaccttttcctcgctgccaagaacctcagcgacgctatactgttgtccgacattcttagggttaataccgaaattacaaaggcccctcttagtgcaagtatgatcaaaaggtatgatgagcatcaccaagaccttacactgctgaaggctctggttagacagcaactccctgaaaagtataaggaaatattcttcgaccaaagtaagaacgggtacgccggttatattgatgggggcgcaagtcaagaagaattttacaaattcatcaagccaattcttgaaaagatggacgggactgaggaattgctggtgaaactgaatagagaggaccttcttagaaaacagaggacatttgacaatgggtccatcccacaccagattcatctgggggaactccacgcaatattgaggagacaagaagacttttacccattccttaaggataatagagagaaaatcgaaaaaatcctgactttcaggattccttactatgttgggccactggccagggggaactcaagattcgcttggatgacaaggaagtcagaagaaaccataaccccttggaattttgaagaggtggttgataagggggcatcagcccagtctttcatagagaggatgaccaactttgataaaaatcttccaaatgagaaggttttgccaaaacatagtcttttgtacgagtactttactgtttataacgaattgaccaaggtgaagtatgtgaccgagggaatgaggaagccagcatttttgtccggggagcaaaagaaagcaatcgttgatcttctcttcaagaccaacagaaaagtgaccgtgaaacaactgaaggaagactacttcaaaaagatagaatgtttcgattcagtggaaattagcggtgttgaagacaggttcaatgcttcattgggtacttaccacgacctgttgaagataatcaaagacaaggactttctcgataatgaggagaacgaagacatcttggaagacattgtgcttacactcactttgtttgaggacagggaaatgattgaggaaagactcaaaacttacgctcatttgtttgatgataaggttatgaaacaactaaaaagaagaaggtacaccggctggggaagattgagtaggaaactgatcaacggtattagagataaacaatccggaaagactatcctcgatttccttaagagtgatggctttgcaaataggaattttatgcagctgattcatgacgactcacttaccttcaaagaagacatccaaaaagctcaggtgtctgggcaaggcgacagtctgcatgaacatatagctaacttggctgggagtcccgccatcaagaaggggatacttcaaacagttaaagttgtggacgaattggtgaaggtaatgggaaggcacaagcctgaaaatatagtgatagaaatggcaagggaaaatcaaacaacccagaagggacagaagaacagtagggaaaggatgaaaaggatagaagaggggatcaaagagcttggtagccagatcctcaaggaacatccagtggagaatacccaacttcaaaacgagaaactctatttgtactacttgcagaacggaagagatatgtatgtggaccaagagcttgatattaacaggctgagcgattatgacgttgaccacatagtgccccaatcattcctcaaggatgactctattgataataaggtgctgacaaggagtgacaagaatagagggaaatccgacaacgttccatccgaggaagttgtgaagaagatgaagaactactggaggcagttgctgaacgctaagctcattacccagaggaaattcgataacctgaccaaagcagagagaggcgggctgagcgaactcgataaagcaggtttcatcaagagacaactcgtggagactaggcaaattactaagcacgtggctcaaatactcgacagcaggatgaacacaaagtacgacgagaacgacaagctcattagagaggttaaggttattactctgaaaagtaaattggttagcgatttcagaaaggatttccaattctataaggttagagagatcaacaattatcatcatgcacatgatgcctatctgaatgctgtggttggtacagcccttatcaagaagtaccctaagctagagagcgagtttgtgtacggagattataaggtgtatgatgtgaggaaaatgatcgctaaaagtgagcaagagattggaaaggctaccgccaaatacttcttttattccaatattatgaatttcttcaagacagaaatcaccctggctaacggcgagataaggaagaggccgcttatcgaaactaatggggagacaggcgaaatagtgtgggacaaagggagggatttcgcaactgtgaggaaggttttgagcatgcctcaggtgaatatcgttaagaaaaccgaagttcaaactggagggttctctaaggaaagcattctccccaagaggaactccgacaagctgattgctagaaagaaagactgggaccccaagaagtatggcggattcgactcacccactgtggcatatagcgttctcgtggtggcaaaggttgaaaagggtaaatccaaaaaactcaaatccgtgaaggaactccttggcataactattatggaaaggagtagctttgaaaagaatcccatcgactttctcgaagctaagggctataaggaagttaagaaggaccttataatcaaacttccaaaatactccctttttgagttggaaaacggcagaaagagaatgttggccagtgccggggagcttcaaaagggcaacgaactggctctgcctagcaaatatgtgaactttttgtatctggcatcacactacgagaaacttaaaggctctcctgaggacaacgagcaaaaacagctctttgttgaacagcataagcactacctcgacgagattattgagcagatcagcgagttctcaaagagagttattctggctgacgctaatcttgacaaggttttgtccgcttacaacaaacacagggataagccaatcagggagcaggcagaaaacataatccatctctttaccctgacaaacctcggtgcccccgctgctttcaagtattttgatactaccattgacaggaagagatatacttccactaaggaagtgctcgacgcaaccctcatacaccaaagtatcacaggcctctatgaaactaggatagatttgtctcaacttgggggcgat

SEQ ID NO: 62 - DNA, 4101 bp, Unknown
  Cas9
gacaaaaagtattccatcgggcttgctatcggaaccaactctgtggggtgggcagttattaccgacgaatacaaggtgcccagcaagaagtttaaggttctggggaacacagatagacatagcataaagaaaaacctgataggcgcactgttgttcgactccggggaaacagccgaagctaccaggctgaagagaactgcaagaagaaggtacaccagaagaaaaaacagaatatgttatctccaagagattttctctaacgagatggccaaggtggacgactcattctttcacagactggaagaatctttccttgtggaagaagataagaaacacgagaggcaccctatttttggcaatatcgtggatgaggtggcttaccacgaaaaataccctacaatataccacctcaggaaaaaattggttgatagtacagacaaggccgacctcaggctcatctatttggccctggcccatatgattaaattcagggggcactttctcatcgagggagatttgaaccccgacaacagtgatgttgataagctctttattcagctcgtgcagacttacaatcagttgtttgaggaaaaccccattaatgcttccggggtggacgccaaggcaatcctttctgcaagactctcaaagtcaaggagactcgaaaatctgatagcacagcttccaggagagaagaagaacgggctctttggaaacctgatcgctctgtcactcggactcacacccaatttcaaaagcaattttgatttggcagaggacgctaagctgcaactcagtaaggatacctacgacgatgacttggataatctgctcgcacaaattggggaccagtatgcagacctgtttctcgcagctaagaacttgagtgacgccatattgctcagtgacatcctcagggttaataccgagattacaaaagctccactctctgcaagcatgatcaagaggtatgacgagcaccatcaagacctgacactccttaaggcgttggttaggcagcaacttcctgaaaagtataaggaaatcttcttcgatcaaagcaaaaacggctacgccggctatatagacgggggagcatcccaagaagaattttataagttcataaaacctatattggagaagatggacgggacagaggaattgctcgtgaaactgaacagggaggatctcctcaggaagcaaaggaccttcgacaatggctccatcccacatcagattcacctcggcgaactgcacgcaatactgagaagacaagaggacttttatcctttcctgaaggacaacagggagaaaatcgagaaaatcttgacattcagaatcccatactacgttgggcctctggccagaggtaacagtaggttcgcctggatgactaggaaatcagaggagactattacaccctggaactttgaagaagttgttgataagggagcttcagcacaatcattcatcgaaagaatgacaaactttgacaaaaatctgcctaatgagaaagtgctcccaaaacattccctgctgtatgagtattttaccgtttataacgagcttaccaaggtgaaatacgttactgaaggtatgagaaagccagcttttctttcaggggagcaaaagaaggctatcgtggatcttctctttaagaccaacagaaaggttaccgtgaagcagcttaaggaagactactttaaaaagatcgagtgttttgactcagtggaaataagcggtgttgaagatagattcaacgcatccttgggaacttatcatgatcttcttaagataatcaaggataaagactttctcgacaacgaggaaaacgaagatatactggaggacatagttctgacacttactttgttcgaggatagggagatgatcgaggaaagactgaaaacatatgctcaccttttcgacgacaaagttatgaaacaactcaagagaaggagatatacagggtgggggagattgagcaggaaactgattaatggtatcagagacaaacagtcaggaaaaacaatactcgactttttgaaatcagacgggttcgcaaataggaatttcatgcagcttatacacgacgattcacttacttttaaagaggacattcaaaaggctcaagttagtggacaaggtgactccctccacgaacacatcgcaaatctcgctggcagccctgcaattaagaagggtatactccagacagttaaggttgttgacgagctggttaaagtgatgggaagacacaaacccgagaacatagtgatagagatggccagggaaaaccaaaccactcaaaaagggcagaaaaattccagagagaggatgaaaaggattgaagaaggtatcaaggagctgggtagccaaattctgaaagaacatcctgtggaaaacactcaactccagaatgagaaactctatctgtactatctgcaaaatgggagagatatgtatgtggaccaggaactggacataaacaggctctcagattacgatgtggatcatatcgtgccacagtcctttcttaaggatgatagcatcgacaataaggtgcttaccaggtccgacaagaacaggggaaagtcagataacgtgccttctgaagaagttgttaaaaagatgaagaactactggagacagctgcttaacgctaagctcataacacagaggaagtttgacaacttgaccaaggccgagagaggcggactctcagaattggataaggcagggttcataaaaaggcagctggtggaaacaaggcagataactaaacatgtggctcagatcctcgatagtaggatgaatacaaaatacgatgagaacgacaagctcataagggaggttaaagtgataactctgaaatccaaactggttagcgattttaggaaggatttccagttttacaaagttagggagatcaacaattatcatcacgcccacgatgcctacttgaacgcagttgtgggtactgcacttatcaaaaagtaccctaagctggaatccgagtttgtttatggagactataaggtgtacgacgttagaaaaatgattgcaaagtcagagcaggagatagggaaagccactgcaaaatatttcttttatagcaatatcatgaatttctttaagacagaaatcacactggccaatggggaaataaggaagaggcccctgatcgaaactaatggcgagacaggggagattgtgtgggataaaggtagggactttgcaacagtgaggaaagtgctgagcatgccccaagttaatatcgttaaaaagaccgaggttcaaacagggggctttagtaaggaaagcattttgcccaagaggaatagtgacaaattgattgctaggaaaaaagattgggaccccaaaaagtatggcggatttgatagccccactgttgcttactccgtgctcgtggttgcaaaggtggagaagggaaagagcaagaaactgaagtcagttaaggaactccttggtatcactatcatggaaagaagctcctttgagaagaaccctattgacttcctggaggctaaagggtacaaagaggttaagaaagaccttatcattaaattgcccaaatatagtcttttcgagcttgaaaacggaagaaagaggatgcttgcatccgctggcgaattgcaaaagggcaatgagcttgctctcccttccaagtatgtgaacttcctttatcttgcctcacactatgaaaaactcaaaggttcacccgaagacaacgaacaaaagcaactatttgtggaacaacacaagcactacctggacgaaatcattgagcaaatttctgagttttcaaaaagggtaatcttggctgacgcaaatctcgacaaagttttgtcagcttacaacaaacatagagataagccaattagagagcaagctgagaatatcatccatctgtttaccctgactaaccttggagcgcctgctgcttttaaatatttcgacaccacaatcgacaggaagaggtacactagcactaaggaagttctcgacgccaccctcatccaccagagtattacaggcctgtacgagacaagaattgatctttctcaacttggtggtgac

SEQ ID NO: 63 - DNA, 4101 bp, Unknown
  Cas9
gataagaagtactcaatcggtctggcaatcggaaccaactctgtgggttgggcagtgattacagatgagtataaggtgccaagcaaaaaattcaaggtgctgggtaataccgacagacacagcattaagaagaatttgattggagcactcctctttgactcaggggaaacagcagaggcaacaaggctgaagaggacagcaaggcggaggtacacaaggcggaaaaacaggatatgctacctccaggaaatctttagcaacgagatggctaaagtggatgatagctttttccatagactcgaagaatcctttcttgttgaagaggacaaaaagcatgaaaggcatcccatcttcggcaatatagttgatgaggttgcataccatgagaagtaccccacaatctaccacctcagaaagaaacttgtggactccacagataaagcagacctgaggctcatatacctcgcactcgcacacatgatcaagttcagagggcactttctcatcgaaggtgacctgaatccagataattcagatgtggataaactgtttatacagctggtgcaaacatacaaccaacttttcgaggaaaacccaatcaatgcctccggtgttgatgcaaaggccatcctgtcagcaagactcagcaaaagcaggcggctcgaaaacctcatcgcccagcttcccggtgaaaagaagaacgggctctttggtaatctcatcgcattgagccttggtcttactccaaacttcaagagcaattttgatctggcagaggatgctaaactgcaactctcaaaggacacatatgacgatgaccttgacaatctgttggcccagatcggggaccaatatgcagacctcttcctggccgcaaagaatctgtcagatgcaatcctcttgtccgacatactgagagttaacactgagatcacaaaggcacctctgtccgcctccatgattaagagatacgatgagcatcaccaggatctgactttgctcaaagccctcgttagacagcagttgccagaaaagtacaaagaaatattctttgatcaatcaaaaaacggatatgcagggtacatcgacggtggggcaagccaggaagagttctacaaattcatcaaacctatcctggaaaagatggatgggacagaagagctgctggttaagctgaatagggaagacctcctcagaaagcagaggacatttgataacgggagcatccctcatcaaatccacctcggtgaactccatgctatcctgagaaggcaggaagacttttatccatttttgaaggacaatagggagaaaatcgaaaaaatcctgacattcagaatcccatactacgttggtcctctggcaagaggtaacagtaggttcgcatggatgacaaggaaaagcgaggagacaatcacaccctggaattttgaggaagttgttgacaagggtgccagcgcacaatcctttatcgaaagaatgacaaatttcgacaagaatctgcctaacgaaaaggttctcccaaagcattcactcctgtacgaatattttacagtttataacgaactgactaaagttaaatacgttaccgagggtatgaggaagccagcattcctttccggggaacagaagaaagctattgtggacctcctgttcaagacaaatagaaaagtgacagttaagcaactcaaagaggattacttcaaaaagatcgaatgttttgactctgtggagatcagcggggtggaggatagattcaacgccagcctgggtacatatcatgatctcctgaaaatcattaaagacaaggacttccttgacaacgaggagaacgaggacattctggaagacattgttctgaccctcacactctttgaggatagggagatgattgaggaaagactgaagacctacgcccacctctttgacgataaagtgatgaaacagctcaagagaagaaggtatacaggttgggggagactgagcaggaagttgatcaatgggattagggacaaacagtccgggaaaacaatcctcgattttctgaagtcagacggtttcgcaaacagaaattttatgcagctcattcacgatgacagcttgacattcaaggaagacatccaaaaggctcaagtgagcggccaaggggatagcctccacgagcatattgcaaatctggcaggttcaccagccatcaaaaagggcatacttcagacagttaaggttgtggacgaattggttaaagttatgggcaggcataagccagagaatatcgttatcgaaatggcaagggagaaccaaacaactcaaaaagggcagaaaaatagcagagagaggatgaaaagaatcgaggaagggatcaaggaacttgggtcccaaatcctcaaggagcacccagttgaaaatactcaactgcaaaacgagaagctctatctctactatctccaaaacgggagggatatgtatgttgaccaggagctggatattaacagactgtcagattatgatgttgatcatatcgtgccccagtcattcctgaaggacgattccatcgacaacaaagttctcacaaggtccgataaaaacaggggcaagtccgataacgttccaagcgaagaagtggtgaaaaagatgaaaaactattggagacaacttctgaatgcaaagttgattactcagagaaagtttgacaacctcacaaaagcagaaagaggcgggcttagcgaactcgataaggcagggtttatcaaaagacagctggttgagacaaggcagatcacaaaacatgtggcacagatccttgactcaaggatgaataccaagtatgatgagaatgataagttgatcagggaggttaaagttatcacactcaaatccaaactggtgtcagacttcaggaaagactttcaattttataaggtgagggagatcaataactaccaccatgcacatgacgcctacctgaacgcagtggtgggtacagcattgattaaaaaataccctaagctggagtctgagtttgtgtacggggactacaaggtgtacgacgtgaggaaaatgatagccaagtccgagcaggagatcgggaaagcaacagctaagtatttcttttacagtaatatcatgaatttctttaaaactgagattactctggcaaacggggagatcaggaaaagacccctcatcgagactaatggtgaaacaggtgagatcgtttgggacaaggggagggattttgctactgttagaaaagttctgagtatgccacaagtgaatattgtgaaaaagacagaagttcagacaggtgggttctccaaagaatccatcctgcccaagagaaattcagacaagctcatcgcaagaaagaaggactgggaccctaagaagtacggaggatttgacagccccaccgtggcctattccgtgcttgttgtggcaaaggtggagaaagggaagagcaaaaaactgaaatccgtgaaagaactgctgggaattaccatcatggaaagaagctcctttgagaagaacccaatcgacttcctggaagcaaaaggatataaggaagtgaaaaaggacctcattatcaagctcccaaaatactcacttttcgagttggagaacggtagaaagaggatgctggcaagcgcaggggaacttcagaaaggcaatgagctggcattgccatcaaagtatgtgaacttcctctacttggccagccattacgagaaacttaaaggtagcccagaagataacgagcaaaaacagctctttgtggaacagcataagcattatctggatgagatcatagaacaaatctcagagttttccaagagagttatcctcgcagatgcaaacctggataaggttctctcagcctataataagcatagagacaagccaattagagagcaagcagagaacattatccacttgttcactcttacaaacctgggggcaccagccgccttcaaatatttcgatacaacaatagacagaaagaggtataccagcaccaaagaagttctcgacgccacactgatccatcaatcaatcacaggcctttacgaaactaggatcgacttgtcacaactgggtggggat

SEQ ID NO: 64 - DNA, 3307 bp, Unknown
  Cas9
gagcaaggacacctacgacgacgacttggacaacctattggcccagataggtgaccagtatgcagacctcttccttgcggccaagaacttgagtgacgctatactgctcagtgacatcctgagggtgaacactgagatcactaaggcccctctctctgcctcaatgattaagcgttacgacgagcatcaccaggatctcaccctgcttaaggcccttgttcggcagcagctccctgagaagtacaaggagatattttttgaccagtctaagaacggctacgccggttacattgacggtggggcaagccaggaggagttctacaagttcatcaagccgatccttgagaagatggacggcaccgaggagctacttgtcaagttgaaccgggaagacctgctccggaaacagcgtacattcgacaacggcagcatccctcaccagatccacctgggcgaactacacgccatcctccgacgtcaggaggacttctatccattcttgaaagataacagggaaaaaatcgaaaaaatacttacgtttcgaataccttactacgtggggccccttgctcggggaaactccagattcgcatggatgaccaggaagtcagaggagaccatcacaccctggaactttgaggaggtggttgacaaaggtgcttctgcccagtccttcattgagcggatgactaacttcgacaagaacctgcccaacgagaaggtgctgccaaagcacagcctgctctacgaatactttactgtgtacaatgagctgacgaaggtgaagtacgtgacagaggggatgcggaagcccgctttcctgagcggcgagcaaaaaaaagcaatcgtggacctactgttcaagaccaaccgaaaggtgacagtgaagcagctcaaggaggactacttcaaaaaaatcgagtgcttcgactctgttgagataagcggcgtggaggaccgattcaacgcctcattgggaacctatcacgacctgctcaagatcattaaggacaaggacttcctggataatgaggagaatgaggacatcctggaggatattgtgctgacccttactctattcgaggacagggagatgatcgaggagcgactcaagacctacgctcacctgttcgacgacaaggttatgaagcaattgaagcgtaggcgatacacggggtggggaagactctcccgaaaactgataaacggcatcagggacaagcagtcagggaagacgatcttggacttcctgaaatccgacgggttcgccaaccgcaacttcatgcagctcattcacgacgactcactaacgttcaaagaggacattcagaaggctcaagtcagtggacaaggcgactccctgcacgagcacattgcaaaccttgcgggctccccggcgattaaaaagggcattctccaaacggttaaggtggtggacgagctggtgaaggtgatgggccgacacaagcctgagaacatcgtgatcgagatggccagggagaaccagactacccagaagggtcagaagaactctcgggaacgtatgaagcgtattgaggaggggattaaggagttgggctctcaaatcctcaaggagcaccctgtggagaacactcagctccaaaacgagaagctgtacctgtactacctgcaaaacgggcgcgatatgtacgtggatcaggagttggacatcaacaggcttagcgattacgacgtggaccacatcgtgccacagtcattcttaaaggacgacagcatcgacaacaaggttctgacgaggagcgacaagaatcgagggaaaagtgacaatgttccatccgaggaggtggtcaagaaaatgaagaactattggcgtcagcttctgaacgccaagctcatcacccagcggaaattcgacaacctgactaaggctgagcgaggcggactctccgagcttgacaaggctggcttcatcaagcggcagttggtcgaaacccgacagataacgaagcacgttgcccagatacttgactcccgtatgaacaccaagtacgacgagaacgacaagctcatcagggaggtgaaggtcattacccttaagtccaaactcgtcagcgactttcgtaaggacttccagttctacaaggtgcgcgagatcaataactaccaccacgcacacgacgcctacctgaacgcagtggttggaaccgcgttgattaaaaagtaccccaagttggagtcggagttcgtttacggggactacaaggtgtacgacgttcggaagatgatcgccaagtctgaacaggagatcgggaaagcaaccgccaagtatttcttctatagcaacatcatgaacttctttaaaaccgagatcacacttgccaatggcgagatccgtaagaggccgctgatcgagacaaatggggagactggcgagatcgtgtgggacaagggccgcgacttcgcaaccgttcggaaagtcttgtccatgcctcaagtcaacatcgtcaagaagactgaggtgcaaacaggcgggttctcgaaggagtccatactgcccaagaggaactcagacaagctcatagcacgcaaaaaagactgggatccaaagaaatacggcgggttcgactcgccgacagtcgcatactccgtgttagtggtggctaaagtggaaaaggggaagtccaagaagctcaagtccgtcaaggagttgctcgggatcaccattatggaacggtcctcattcgagaagaatcccattgacttcctagaggcgaagggctacaaagaggtcaaaaaggacctaattattaagctccccaagtattcactcttcgaacttgaaaatggtcgtaagcggatgttggcaagcgctggagagcttcagaaggggaacgagcttgcactgccttccaagtacgtgaacttcctgtacctcgcctctcattacgagaagttgaagggctcaccggaggacaacgagcagaagcagttgttcgtggagcagcacaagcactacctcgacgagatcattgagcagataagtgagttcagcaaacgggtgatccttgccgacgctaacctggacaaggtgctgagcgcctacaacaagcacagagacaagccgatccgagagcaagcggagaacatcatacacctgttcaccctcacgaacctcggggctcccgcagccttcaaatattttgacacgaccatcgaccgtaaacgctacactagcacgaaggaggtgctggacgctacccttatccaccagtccatcaccggcctgtacgagacgagaatcgacttgtcgcagctcggtggtgac

SEQ ID NO: 65 - DNA, 4101 bp, Unknown
  Cas9
gacaaaaaatactcaattggtctggcaattgggaccaacagtgtcggatgggccgtgattaccgacgagtacaaggtgccgtccaaaaaattcaaggtgcttgggaacaccgaccgccactcgatcaagaaaaacctaatcggtgcgttgcttttcgacagtggggagaccgccgaggcaacacgcttaaaacgcacagctaggaggagatatacacggcgcaagaaccgaatatgctacttacaggagatattctccaatgagatggcgaaggtggacgactctttcttccatcggcttgaggaatccttcctggtcgaggaggacaagaagcacgagcgacacccgatattcgggaacatcgttgatgaggtggcgtaccacgagaagtacccaacgatataccacttacgcaagaagctcgtggactctacggacaaggccgacttgcgccttatctacttggcactggcccacatgattaagttccgaggccacttccttatcgagggtgacctgaaccccgataactccgacgtggacaagctcttcatccaactcgtccagacatacaaccagctattcgaggagaatcctatcaacgcctctggggtggacgctaaagctatcctctcagcccgcctgtcaaagtcgaggaggttggagaacctaatcgcccagcttccaggcgagaagaaaaatgggctgttcggaaaccttatcgcactctcactgggcctaaccccgaacttcaagtccaacttcgacctggcagaggacgcgaaattgcagttgtcgaaagacacctatgacgatgacctggacaacctgttggcccagataggggaccagtacgccgacctgttcctagcggccaagaacctgtccgacgccatcttgctgtcggatatactgcgggtgaacaccgagatcactaaagcacctctctccgccagcatgattaagcgttacgacgagcaccaccaagatttgaccctgctaaaggcacttgtacggcagcagcttcccgagaagtacaaggagatctttttcgaccaaagcaagaacggctacgccgggtacatcgacggaggtgccagccaggaggagttctacaagttcattaagcccatcctggagaagatggacgggactgaggaactacttgtgaagctgaaccgggaagacttactacggaagcagcgtaccttcgacaacggttctatcccacatcagatccatcttggggagttgcacgcgatcctgcgacgccaggaggacttttaccccttcctgaaagacaaccgcgagaaaatcgagaagatactgaccttcagaataccttactacgtcggaccccttgcgcgaggcaactcaagattcgcgtggatgaccaggaaatcagaggagaccatcacaccctggaatttcgaggaggtggttgacaagggtgcctccgcccagtcctttatcgaacgaatgaccaacttcgacaagaacttgcccaacgagaaggtgctccccaaacacagcctcctctacgaatatttcacagtgtacaacgagcttactaaagttaagtatgttactgagggcatgaggaaacccgccttcctgtcaggcgagcagaagaaagctattgtggacctccttttcaagaccaaccggaaggtgacagtgaagcagctcaaggaggactacttcaagaagatagagtgcttcgacagcgtggagatcagcggggtggaggacagattcaatgcctctctcggaacataccacgacttgcttaagatcatcaaggacaaggacttcctcgacaacgaggaaaacgaggatattctggaggatattgttctgactcttaccctgttcgaggaccgggagatgatcgaggagcgtctcaagacctacgcccacctgttcgacgacaaagttatgaagcagctcaagcgtcggagatataccggatggggccgtctgtctcggaagctcatcaacgggatcagggacaagcagtcagggaagacgatcttagacttccttaagtctgacggcttcgccaacaggaacttcatgcagttgatccacgacgacagccttaccttcaaggaggacatccagaaggcccaagtgagtggccagggtgacagcctccacgagcatattgctaatcttgcgggttccccagcgattaaaaagggcatacttcaaaccgttaaggtggtggacgagcttgtcaaggtgatggggcgacacaagcccgagaacatcgtgatcgagatggccagggagaaccagaccacccagaaggggcagaagaatagccgagaacgcatgaagcgcatcgaggaggggattaaggagctagggagccagatcctcaaggaacatcccgtcgagaacacccagctccagaacgagaagctatacctctactacttgcaaaacgggagggatatgtacgtggatcaggagttggacattaaccgcctaagcgactacgacgtagatcacatcgtgcctcagtcattcctcaaagacgacagcattgacaacaaagtcttgacccgatccgacaagaaccgaggaaaatccgacaatgtgccctcagaggaggtcgtcaagaaaatgaagaactattggaggcagctacttaacgccaaactcataacccagcggaagttcgacaacctgacaaaggctgagcggggtgggctcagcgagcttgacaaggctggcttcatcaagcggcagttggtggagacaagacagataacgaagcacgtggctcagatcctggactctcgcatgaacacgaagtacgacgagaacgacaaattgatccgcgaggtcaaggttattacgctcaagagcaaacttgtcagcgatttccgcaaggacttccagttctacaaggtgagggagattaacaactaccaccatgcacatgatgcctacttgaacgcagtggtggggaccgcgcttattaaaaagtaccctaagttggagtcagagttcgtttatggggactacaaggtgtacgacgtccggaagatgattgcaaagtctgaacaggaaatcgggaaggccaccgccaaatatttcttctacagtaacattatgaatttttttaagactgaaattactctcgcaaacggcgagatcaggaagcgtcccctcatcgagacaaacggggagaccggggagatagtctgggacaaggggcgggacttcgctacggtgaggaaggtgctctcgatgccacaagtgaacatcgtcaaaaagacagaggtgcagaccggtggcttctcaaaggagtcaatcctgccaaaacgtaacagcgacaagctcatcgcccgcaagaaagactgggaccctaagaagtatggtgggttcgactcaccgacggtcgcatactccgttctggtcgtggcaaaggtggaaaagggcaagtccaaaaaactgaaatccgtgaaggagttgcttggcattaccatcatggaacgcagcagcttcgagaagaaccccattgacttcctggaggctaaagggtacaaggaggtcaagaaagatttaattattaagctacctaagtacagcttgttcgagctggagaacggccgaaaacgaatgctcgcatccgccggggaacttcaaaagggcaacgagcttgcgctgccctccaagtacgtgaacttcctgtacttggcatcccactacgagaaactcaagggtagcccagaggacaacgagcagaagcagctattcgtggagcagcacaagcactacctcgacgagataatcgagcagatcagtgagttcagtaagcgggtgatactcgcggacgccaacttggacaaggtgcttagtgcctacaacaagcaccgtgacaagcccatccgagaacaggctgagaacatcatccaccttttcactctgacaaacctcggtgctcccgccgccttcaaatacttcgacactaccatcgacaggaagcgctacacatctacgaaggaagttcttgacgctacgcttattcatcagtctatcacagggctgtacgagacaaggatcgaccttagccaactcggcggggat

SEQ ID NO: 66 - DNA, 2360 bp, Brassica juncea
atgaagcatctttggctcacattagcttttctattggctttggcaacttgcaaagctgatgaagaaattacttgcgaagagaacctgccattcacatgtggtcaaactgatcgtttcaacagtagcagtttcgagaaagacttcatcttcggtcttgcatcttctgcttaccaggcatgtaacatatatatcaaccattagtattatgttgccagacgtcatattttacgtataaaacatcatatataaacattaaaatccaacgttgcatggttgtttcttttcatttcagatcgaaggtagcataaatcgtggagttaacgtttgggatggcttcactcaccgattcccacgtttgtttttttgcatggttactcatcacatatacatattatgtcggttatatgtctccatgcacttatagttatgtatttatttactatcagataaagcaggacccgatcatggaaatggagacactacttgtaactcatattcgtactgggaggtaattaaattcctcaatatatatgtgtgtgcatattaatattactcactgaattatttatcgactaccaacctagtgcggattgacatgcgattatatgtgaactgcagaaagatatagaggtgatggatgaactcaaagctactggctacagattctccattgcctggtcaagaatcattccaagtatgtgaacgttattgatccatgtatatatataaatcgtatatggtaatattcgattatgattctttcgaaagattaaatataggatacatatgagcaggaggaaagaggagcaggggagtacaccaaggaggtattaactactaccacggactcataaatggcctcatcgaaaagggtataacgcctttagttacgctctttcactgggaccttcctcaagtactacaagatgaatatgaaggtttattggaccctcagatcatgtatgatatatttatgccatgctgcttattaagaaagacgacaatatataaagatttgttcttggattaatgaaatgactataatattcgcagagatgatttcagagatttcgcggatctatgttttgaagaatatggtgataaagtaaagcactggttcacaatcaaccagctctactcagtgcctacgagaggctatggattaggatcagatgcacctggtcgatgttctccaaaggttgattctacatgttacgccggaaattcttcaacggaaccctatattgttgcacataaccagctccttgctcatgccacggtggtcgatctttacaggacaaaatataaggcaggttctccattttatgaaaggtgtattatctgattctaaattaatcatatcgatgggtatatatatctgcgtgaccacagcatcaaggaggtaagattggacctgtgatgataactagatggtttcttccatataatgacactgatccagactccatagctgcaaccgagaggatgaaagaattcttcttgagatggtatatgttttataaaatgaaatgatattcttaacatgaatatatgctgtatatatgaactgacgaaaaatatgtatatatatgtacaccaggtacatggggccgctaacaaatggtacataccctcaaatcatgatagacactgtgggtgagcggctaccatcgttcactccagaggaatccaaactcgtaaagggttcatatgattttcttggtctcaactattacttcactcagtatgtccagccaagtcctaatcatgttgattcggatggtcacactgccatgatggacgctggcacaaggctcacatgtatccatctatatatttcgacttagttacaaccttaatttatatctacctaacgccttttgttaattacaataatttgtgttaacagatcgtaatgcaagtaatcatgccattggcccagtggtatatatatatatatgcatcatccatccctattctttcattcttttttctaagcaaaattcagttttctgatactaatttgcttccctttctaagttcactgaacacaaagatgacgagaccaaaaacacctattactacccaaaaggcatttattatgtgatggatcacttcaaaaccaattacaatgaccctgtaatctatataaccgagaacggtgggttctactactcatctctaaattcatctttacatgttaaatgtaatttgaaatttgttgaaattgttcatgttatgacggttaactaggattcagtacctccggtgatgaaacccgtgaggaggctaagtttgattacaggcggattgattatctctgcagtcatctctgtttcctcagtaaagtcatcaagtga

SEQ ID NO: 67 - DNA, 2379 bp, Brassica juncea
atgaagcttcttcatggactcgctttagtttttctattagctgctgcgagttgcaaagctgatgaagaaattacttgcgaagagaacaatccattcacatgtagtaacactgatattttaagcagtaaaaacttcggaaaagacttcatcttcggtgttgcatcttctgcttaccaggcatgtaacaaatttttttgacgtataaataaatacaattcaaaaatactaaaatgcaacttcgcatggttgtttcttttcatttcagatcgaaggaggaagaggtcgtggtgttaacatttgggatggcttcagtcaccgatatccaggtacgtcacagtgtatatatacacatgagatgaacgtcggtttatatgtacacatattaatgtatttgtaactactatcagagaaatcagggtcagatttgaagaatggagacactacttgtgagtcatatacgagatggcaggttaatacattgatactcatatgactgaactatatatgtataaaaactatacgtgtggattgacatgtgattaaaatatgtaaaccgcagaaagatgtagacgtgatgggcgaactcaatgctactggctacaggttctcctttgcgtggtcaagaatcattccaagtatgtacatgttatcgattcgtttgtattttaattgggatcatttagttgagaaaagtactaattaatgtacgacatatatatacatgagcagaaggaaaggtgagtaggggagtgaaccaaggaggtcttgattactaccacaaactcatagatgcactactcgaaaagaatataacgcctttcgttaccctctttcactgggaccttcctcaaacactccaagatgagtatgaaggtttcttagaccgccagatcatgtatgtttatatttgttccatgcttcttatattataaataagagaagaaaacgttttggttttagttacatgcattaatgaaatgattctgtataatatgcacagacaagatttcaaagactacgcggatctatgtttcaaagaatttggtggaaaggtaaagcactggatcacgatcaaccagctatacacagtccctacgagaggctatgcggtcggaacagatgcacccggtcgatgttctcctatggttgataccaagcacaggtgttacggtggaaattcttcaacagaaccctacatcgttgcacataaccagcttcttgctcatgccacggtcgtcgatctttacaggaccaaatataaggtgagtggtctctccatattaaggtggtgcaaatctaacatatctgattctaatgtatagtcatatatatatatatatcacgtgaccaacagtttcaaaaagggaagattggacctgtgatgataacaagatggtttcttccatttgatgagtctgatcctgcctccatagaagcagctgagaggatgaaccaattctttcatggatggtatatatatatattacagaacaatgtaacagtatatagtgtatgtatgtataattaaaagatatacatggatcaggtacatggagccgctaacaaagggtagatacccagacatcatgaggcagattgtgggtagtaggcttcccaactttaccgaggaagaagcccaactcgttgccggttcatatgattttcttggtctcaactattacgtcactcagtacgcccagccaaaacctaacccatatccttcagagacacacactgccatgatggacgctggcgtaaagctcacatgtactagtctattaccactaattagatacagcctttctatacatataaatattcttttatctcctttttgttgcaacatactttgtgagtgaccatctgttatttcatccttgtgtttacagatgataactcacgtggtgaatttcttggtccactggtatatatcaatgatccaccccctaagatttgtttttctttcattttttcagttttcagtataacaaccctaattatgttttttaattgatgtgtatatttatttacttccattttcacagttcgttgaagacaaggtaaacggcaacagctattactacccaaaaggcatttactacgtaatggactacttcaaaaccaaatacggagaccctttaatctatgtcaccgagaacggtgagttttacgaactcttttcatttataccacataataattattgtattttgatattagtcgaagaaactgactttattgtggaatatttttaatgtggcggtttatttaggatttagtacccccagtgaagaaaaccgtgagcaggctattgccgattacaagcgaattgattatctctgcagtcatttatgttttctccgcaaggtcatcaagtga

SEQ ID NO: 68 - DNA, 2414 bp, Brassica juncea
atgaagcttcttcatggactcgctttagtttttctattagctgctgcgagttgcaaagctgatgaagaaattacttgcgaagagaacaacccattcacatgtagtaacactgatattttaagcagtaagaacttcggaaaagatttcatcttcggtgttgcatcttctgcttaccaggcatgtagcaaatgttgtcacaccataattttgaaataaaatttaaaacactaaaatgcaactttgcatggttgtttcttttcatttcagattgaaggagggagaggtcgtggtgttaacgtttgggatggcttcagtcaccgatacccaggtatgtcatttgcacagcgacatctatatttatatgtgagaggaatgttggttacatatactcatatagtcatattaatgtatttgtaactactatcagagaaatcagggtcagacttgaagaatggagacactacttgtgagtcctatacgagatggcaggttaatacattgatactcgtatgattgaactatatatgtataaaaactatacgtgtggaattgacatgtgattaaaatatgtaaactgcagaaagatgtagacgtgatgggcgaactcaatgctactggctacaggttctcctttgcgtggtcaagaatcattccaagtatgtacatgttatccattcgtttgtattttaattgggatcatttagttgaaaaagtactaattaatgtacgacatatatatacatgagcagaaggaaaggtgagtaggggagtgaaccaaggaggtcttgattactaccacaaactcttagatgcactcctcgaaaagaatataacgcctttcgttaccctctttcactgggaccttcctcaaacactccaagatgagtatgaaggtttcttggaccgccagatcatgtatgtgccatgcagacatattatatatgaatttaagagattgattataaaattattaataaaaaagaagaaggtttggtcttatttaattacatgtattaactgaaataattatatattcatatgcagacaagatttcaaagattacgcggatctatgtttcaaagaatttggtggaaaggtaaagcactggatcacgatcaaccagatatacacagtccctacgagaggctatgcggtcggaacagatgcacccggtcgatgttctcctatggttgataccaagcacaggtgttacggtggaaattcttcaacagaaccctacatcgttgcacataaccagcttcttgctcatgccacggtcgtcgatctttacaggaccaaatacaaggtgagttgtctcaatacgtgataaagatggtgtagtgtaatctaagatatctgattctaacttagtcatatatcacgtaaccaacagttccaaaaagggaagattggacctgtaatgattacaagatggtttcttccatttgatgagtctgatcctgcctccatagaagcagctgagaggatgaaccaattcttccatggatggtatatatatatatttatattaccaaaaatgtatcagtataaattgtatatatgtataatgaaaagatatacatggatcaggtacatggagccgctaacaaagggtagatacccagacatcatgaggcagattgtgggtagtaggcttcccaacttcaccgaggaagaagcagaactcgttgctggttcatatgattttcttggtctaaactattacgtcacccaatacgcccagccaaaacctaacccatatccttcagagacacacactgccatgatggacgctggcgtaaagctcacatgtacttttctattaccacttagttacaaccttttgatatatataaatgttttatctcctttttgtgagtgaccatcagttatttcattcttgtggttacagatgataattcacgtggtgaatttcttggtccactggtataatatgaatgatccacccctatgatttctaattcattttattttttcaattttcaatataagcaccactaattaggttttcttgattgatatgtatacgcttaactcccgtttctcagtttgttgaagacaaagtaaacggcaacagctattactacccaaaaggcatttattacgttatggactacttcaaaaccaaatacggcgaccctttaatctatgtcaccgaaaatggtgagttctacatgcatatattttcatctataacatctactataatttgtgtatttcgaaataaatccaagaaactgactttcaaatattgtgtactttttcatgttatgtcggtttaattaggatttagtacccccagttcagaaaaccgtgagcaagctattgccgactacaagcgaatcgattatctatgcagccatctatgttttctccgcaaggtgatcaagtga

SEQ ID NO: 69 - DNA, 2414 bp, Brassica juncea; identical to SEQ ID NO: 68

SEQ ID NO: 70 - DNA, 2484 bp, Brassica juncea
atgaagcttcttgggctcgctttagtttttctgttagcttctgcgagttgcaaagctgacgaagaaattacttgtgaagagaacaatccattcacatgtagtaacactgatattttaagcagtaaaaacttcggaaaagacttcatcttcggtgttgcatcttctgcttaccaggcatgtaacaaatgttgacataccatactttttgacgtatagaaaacactattcaaaaatgataatatctaactttgcatggttgtttcttttcatttcagatcgaaggagggagaggtcgtggtgttaacatttgggatggcttcagtcaccgatacccaggtatgtcgtttgcacggtgacatctatatatatcatatatgacaggaatgttggttataagtactcatattaatgtatttgtaattactatcagagaaatcagggtcagatttgaagaatggagacactacttgtgagtcatatacgagatggcaggttaattcttcagtacatttctagatactcatgactgaactatgtatacaaactacgtgccgattgagatgcaatcaaaatatgaaactgcagaaagatgtagacgttatgggcgaactaaatgctactggctacagattttcctttgcgtggtcgagaatcattccaagtacgtacagattatcgatcagtacatgtatatatatagttggacgtgttttaaatgtacgatttatatatacatgagcagaaggaaaggtgagtaggggagtgaaccaaggaggtcttgattactaccacaaactcatagacgccctcctcgaaaagaatataactcctttcgttaccctctttcactgggaccttcctcaaacactccaagatgagtacgaaggtttcttggaccgccagatcatgtatgtttatatttgtgacatgcttcttatattattaataagagaagaaaaagatggttaattttagttacatgcattactgaaatgattctatattaatatgcacagacaagatttcaaagattatgccgatctatgtttcaaagaatttggtggaaaggtaaagcactggatcacgatcaaccagctatacacagtccctacgagaggctatgcagtcggaacagatgcacccggtcgatgttctcctatggttgatactaagcacaggtgttacggcggaaattcttcaacagaaccctatatcgttgcacataaccagcttcttgctcatgccacggtcgtcgatctttacaggaccaaatataaggtgaatgctgtctccatatgtgaaaattaaggtggtgtctaacatatctgattctaatgtaaatatcacgtgaccaacagttccaaaaagggaagattggacctgtgatgataacaagatggtttcttccatttgatgagtctgatccggcctccatagaagcagctgagaggatgaaccaattcttccatggatggtatatatatatattaccaaaaatgtaacagtatctactgtatttgtatgtatgtataatggaaaaatatacatggatcaggtacatggagccgctaacaaagggtagatacccagacatcatgaggcagattgtgggtagtaggcttcccaactttaccgaggaagaagccaaactcgttgccggttcatatgattttcttggtctcaactattacgtcactcagtacgcccagccaaaacctaacccatatccttcagagacacacactgccatgatggacgctggtgtaaagctcacatgtaagtaccacacaatattactacttagttacgacctttctatatattttttttcttctttttgttaacatactttgtgagagtatcaattatttcatccttgtgtttacagatgataattcgcgtggtgaatttcttggtccactggtatatatgaatgaaccacccctatgatatctctttcattttttattctatttgcaatatatagaacaccactgattatgttctcgtgattgatatgtatatttgtttgcttcccttgctcagttcgttgaagacaaagataacggaaacagctattactatccaaaaggaatttattacgtgatggactacttcaaaaccaactacggcaaccctttaatctatgtcaccgagaacggtgagttctacatactactactcctctattttcatttataccacgcataatattatgtaaccacaaaagtagacccatattcaatctaccgcagggtgaatagtaatgaaaataattgtaaaagttattttacaattattgtattttcgaaattggtccaagaaactaacttacaaatattgtgtaatatttttcatgcaatggcggcttaattaggatttagtacgcccagttcagaaaaccgtgagcaggctattgcggattacaagcgaattgattatctctgcagtcatctatgttttctccgtaaggtcatcaagtaa

SEQ ID NO: 71 - DNA, 2502 bp, Brassica juncea
atgaagcttcttcatggacttgctttagttttcctattagctgcttcgagttgcaaagctgatgaagaaattacatgtgaagagaacactccattcacatgtggtaacactgatattttaagcagtaaaaactttggaaaagacttcatcttcggtgttgcatcttctgcttaccaggcatgtaacaaatgttgacataccatactataaataaatacaattcaaagagctaatttccaactttgcatggttgtttattttcctttcagatcgaaggagggagaggtcgtggtgttaacatttgggatggcttcagtcaccgatacccaggtatgtcgtttttgcacggtgacgtacgtgtgtatatatatatatatatataatgtacacatattaaagcatttgtaattactatcagagaaatcagggtcagatttgatgaatggagacactacttgtgagtcatatacgagatggcaggtcagtacattgatactcacatgactgaactatgtataaaaaaacctatacgtgtgattgttgacatgccattaaaatatgtaaactgcagaaagatgtagacattatgggagaactcaatgctactggctacagattctcctttgcgtggtcaagaatcattccaagtatgtacatattattgattgttcgtaattgggatcgtttagttggaaaagtactgattaatgttttggcaaaaaaaaaagtactgattaatgtacaatatatatatgtatgcacgagcagaaggaaaagtgagtaggggagtgaaccaaggaggtcttgattactaccaccaactcatagacgccctcctagaaaagaatataacgcctttcgttaccctcttccactgggaccttcctcaaacactccaagatgagtatgaaggtttcttagaccgccagatcatgtatgtttatatttatgccatgcttcttatattattaataaaagacgaaaaagatttggttttagtaacatgcattactgaaatgattatacaataatatgcacagacaagatttcaaagattacgcggatctatgtttcaatgaatttggtggaaaggtaaagcactggatcacgatcaaccagctatatacagtgccgacaagaggctatgcgagcggaacagatgcacccggtcgatgttcttatatggttgataccaagcacaggtgttacggcggaaattcttcaacagaaccctacatcgttgcacataaccagcttcttgctcatgccgcagttgtcgatctttacaggaccaaatataaggtgagtggtgctccatatgtgaaaattagggtggtgtaaatctaacatatatctgattctaatgtatagtcatatatatgtatcacgtgaccaacagttccaaaacgggaagattggacctgtgatgataacaagatggtttcttccatttgatgagtctgatcctgcttgcgtagaagcagctgagaggatgaaccaatttttccatggatggtatttatatatatatatatatatatatatatgtgtgtgtgtgtattaccaacaatgtatcagtatgtattttatgtatttataatgaaacaaaaatatacatggatgatggatcaggtacatggagccgctaacaaagggtagatacccagacatcatgaggcagatcgtgggtagtaggctccccaactttaccgaggaagaagccgcactcgttgctggttcatatgattttcttggtctcaactattacgtcactcagtacgcccagccacaacctaacccatatccttcagagacacacactgccatgatggaccctggtgtaaagctcacatgtacgtacttcagtaatattaccacttagtacttatcaaaaaaaaaaaaaattaccacttagttacaacctttctatatatgtttttctccttttgttaacatactttgtgagtgactatcaattatttcatccttgtgtttacagataataattcacgtggtgaattacttggtccactggtaatatatgaatgatccacctctacgatttctcttttttttaatcaatattttctatttgcaatagaacaccactgattatgttctcttgattgatatgtatattttgtttggttccctttctcagttcgctgaagacaaggttaacggcaacagctattactacccaaaaggaatgtattacgtaatggacttcttcaaaaccaattacagcaaccctttaatatatatcaccgagaacggtgagttctacatactacttactactcatctattctacataaattaactagtgtattttatatattagtccaggaaactgactttcaaatatcgtggaatgttttcatggtttaattaggaattagttcgcccggtacagaaaaccgttgcgaagctattgccgattacaagcgaatcgattatctctgcagtcatctctgttttctccgtaaggtcatcaggtaa

SEQ ID NO: 72 - DNA, 2431 bp, Brassica juncea
atgaagcttcttcatggactcgctttagtttttctattagctactacgagttgcaaagcagatgaagaaattacttgcgaagagaacaatccattcacctgtagtaacactgatatattaagcagtaagaacttcggaaaaaatttcatcttcggtgttgcatcttctgcttaccaggcatgtagcaaatgttgtcataccccacttttgaaataaattttaaagcactaaaatgcaactttgcatggttgttcttcttatttagatagaaggagggagaggtcgtggtgttaacgtttgggatggcttcagtcaccggtacccaggtatgtggtttgcacggtgacatatatatttatatgcgagaggaatgttggttacatatacacatattaatgtatttgtaactaaaatcagagaaagctgggtcagatttgaagaatggagacactacttgtgagtcatatacgagatggcaggttaatttctcagtacattaataatcatgactgaactatatatgtataaaaactatacgtgtggattgacatgagactaaaattaatatgtaaactgcagaaagatgtagacgtgatgggcgaaatcaatgctactggctacagattctcctttgcatggtcaagaatcattccaagtatgtacatattaacgatcaatgtatatatatctttgtattttaattgggataatttagttggaaaggtactaattaatgtacgatatatatctacccgagcagaaggaaaggtgagtaggggagtgaaccaaggaggtcttcaatactaccacaaactcatagatgcactcctggaaaagaatataacgcctttcgttaccctctatcactgggaccttcctcaaacactccaagatgagtatgaaggtttcttggaccgccagatcatgtatgttccatgcttcttaattatatttgaagagagtcaatattattagtgatagaagaagatttagtctcaattacatgtattactgaaatatttctatactaatatgcacagccaagatttcaaagattacgcggatctatgtttcaaagaatttggtggaaaggtaaagcactggatcacaatcaaccagctatacacagtgcctacgagaggctatgcactcggaacagatgcacccggtcgatgttcttatatggttgataacaagcacaggtgttatggcggaaattcttcaacagaaccctatatcgttgcacataaccagcttcttgctcatgccacgatcgtcgatctttacaggaccaaatataaggtgagtgatctccctatgtgaaaaggtggtctaaatcaaacatatccgattctaatgaatagtcatatatatatatatatatatcacgtgatgagcagttccaaaaagggaagattggacctgtgatgataactagatggtttcttccatatgatgagtctgatccttcttgcgtagaagcagctgagaggatgaaccaattcttccatggatggtatatataattttttatatagccaaaatatatcagtatgtattttatgcatttataatgatacaaaaatatacatggatgatggatcaggtacatggagccgctaacaaagggtagatacccagacatcatgaggcagattgtgggtagtaggctccccaacttcactgaagctgaagccgaactcgttgctggttcatatgattttcttggtctcaactattacgtcactcagtatgcccagccgaaacctaacccatatccttcagagacacacactgccttgatggacgctggcgtaaagctcacatgtacgtactacagtattaccacttagttacaacctttctatatatctttttctcctatttgttaacatactttgtgagtgactatcaatttatttcattcttgtgtttacagatgataattcacgtggtgaattccttggtccactggtatattaatgatccacccctatgatttctcttttatttttttctattttcaatataacaccacttatgctctctttattgacatgtatatgtgttcgcttccctttcccagttcattgaagacaaagacaacggcaacagctattactacccaaaagggatttattacgtaatggactacttcaaaaccaaatacggtgacccattaatctatgtcaccgagaatggtgagttctacatactactactcatctttttcatctataacgtatactaaataatgtatttcggaataaatcccagaaactgactttcaaatattgtgtacctttgcatgttatggcggttaggatttagcacgcccactacagaaaaccgtggcgaagctattgccgattacaagcgaattgattatctttgcagtcatctatgttttctccgtaaggtcatcaagtga

SEQ ID NO: 73 - DNA, 2440 bp, Brassica juncea
atgaagcttcttcgtcgactcgctttagtttttctattagctgctgcgagttgcaaggctgatgaagaaattacttgcgaagagaacaatccatttacttgtagtaacactgatattttaagcagcaagaacttcggaaaagatttcatctttggtgttgcgtcttctgcttaccaggcatgtagcaaatgttgtcacaccctaattttgaaataaaattcaaagcaccaatatccaattttgcatagttgtttcttttcatttcagattgaaggagggagaggtcgtggtgttaatgtttgggatggtttcagtcaccggtacccaggtatgtcgttcgcacggtgacatctaaactaataatgttggttacatatacacatattaatgtatttgtaattaatattatcagagaaagctgggtcagatttgaagaatggagacactacttgtgagtcatatacgagatggcaggttaatttctgagtacactgattctcatgactgaattatatatgtataagaactccctaaaaactatacgtgtggattgacatgaaatttaaattaattgtaaactgcagaaagatgtagacgtgatgggcgaaatcaatgctactggctacagattctcctttgcatggtcaagaatcattccaagtatgtacatattaacgatcaatgtatatatatctttgtattttaattgggataatttagttggaaaggtactaattaatgtacgatatatatctacccgagcagaaggaaaggtgagtaggggagtgaaccaaggaggtcttgattattaccaccaactcatagatgcactcctcgaaaagaatataacgcctttcgtaaccctctttcactgggaccttcctcaaacactccaagatgagtatgaaggtttcttggaccgccagatcatgtaggtgccatgcttcttaattatatttgaggagagtaaatattattagtaatagaagaagaagatttagtcttaattacatgtttactgaaatgattctatactaatatgaacagccaggatttcaaagattacgcggatctatgtttcaaagaatttggtggaaaggtaaagcattggatcacgatcaaccagctatacacagttcctacaagaggctatgcagtcggaacagatgcacccggtcgatgttctcctatggttgataccaaacacaggtgttacggcggaaattcttcaacagaaccctacatcgttgcacataaccagcttcttgctcatgccacggtcgtcgatctttacaggaccaaatataaggtgagtggtgactccatatgtgaaaattagagtggtgtaaatctgatatatatctgattctaatgtatagtcatatatttggaccaacagttccaaaacgggaagattggacctgtgatgataacaagatggtttcttccatatgatgagtctgatcctgcctgcatagaagcagctgagaggatgaaccaattcttccatggatggtatatataattttatatattatcaaaaatgtatcagtatgtattttatgtatttataatgaaacaaaaatatacatggatcaggtacatggagccgctaacgaagggtagatacccagacatcatgaggcaaattgtgggtagtaggcttcccaactttaccgaggaagaagccgcactcgttgccggttcatatgattttcttggtctcaactattatgtcactcagtacgcccggccacaacctaacccatatccttcagagacacacactgccatgatggacgctggagtaaagctcacatgtactaatttacattaccacttagttacaacctttccgtacatatatatatacacatgttctatctcctttttgttacaacatactctgtgagtggccatcaattgtttcatccttgtgtttacagatgataattcacgtggtgaaatacttggtccactggtaatatatgaatgatatccacccctatgatttctcttttatttttatttttctatctgcaatagaacaccactgattatgttctcttgattgatgtgtttgcttccctttctcagttcgctgaagacaaagttaatggcaacagctattactacccaaaaggaatttattacgtaatggactttttcaaaaccaattacagcaaccctttaatctatatcaccgagaacggtgagttctacattctacttactactcatctattctacataaaataattagtgtatttttatatatataagtccaataaactgactttcaatattgtggaatgttttcacggtttaattaggaattagttcgcccagtacagaaagccgttgtgaagctattgccgattacaagcgaattgattatctctgcagtcatctatgttttctccgtaaggtcatcaagtga

SEQ ID NO: 74 - DNA, 2426 bp, Brassica juncea
accatgaagattcttcatggactcgctttagtttttctattagctattgcgagttgcaaagcttatgaagaaattacttgcgaacagaacgaaccattcacatgtggtaacactgatatcttaagcagtaaaaacttcggagaagacttcatcttcggtgttgcatcttctgcgtaccaggcatgcaacaaatgctgccataccatatttttgacgtatagaaaataatattcaaaaatgctaacatcaaactttgcgtggttgtttccatttcagatcgaaggagggagaggtcgtggtgttaacgtttgggatggtttcagtcaccgatacccaggtatgtcacggtggcatatatatacatataagatgaatgtcgtttatatctacacacattaatgtatttgtaattactatcagagaaatcagggtcagatttgctgaatggagacacttcttgtgagtcatatacgagatggaaggttagttcctcagtacatatacactcatatgactaaactacgtataaaatttacgtgtgaactgaattccgtttaaaatgcagaaagatgtagagattatgggagaactcaatgctactggctacagattctccttagcgtggtcaagaatcattccaagtacgaacataaatttgtatttttattgggatcctttagctggaagagtatactaattaatgtatgatataaatgagcagaaggaaaggtgagtaggggagtgaaccaaggaggtcttgattactaccaccaactcatagacgccctcctcgaaaagaatataactcctttcgttaccctctttcactgggaccttcctcaaacactccaagatgagtatgaaggttttttggatcgccagatcatgtatgtgccatgcttcttaattatatacaaattattaataaaaacaagaagaagaagaagaaggttttgtcttaattacatgctttactgaaagaatgattatatattaatatgcacagacaagatttcaaagactatgcggatctatgtttcaaagaatttggtggaaaggtaaagcactggatcacgatcaaccagctattcacagtgcctacgagaggctatgcactcggaacagatgcacccggtagatgttctcctatgattgatgagaggtgttacggcggaaactcttcaacagaaccctatattgttgcacataaccagcttctcgctcatgctgcggtcgtcgatctttacaggaccaactataaggtgagtagtctccatatttaatacgatggtgtgatcttaatccatctgattctgatctagtcatatatatcatgtgaccaacaggaccaacaagggaagattggacctgtgatgataacaagatggtttcttccatatgatgagtctgatcccgcttgcgtagaagcagctgagaggatgaaccaattcttccatggatggtatatcttttttgtttgacatcaaacaattattcttttttttgtttgtttacattaaatggttattttattatttaaaactaaaggtggtctgtataactagaatgattatattgtatgtataatgaaaaaaatatacaccgatcaggcacatggagccgctaacaaagggtagatacccagacatcatgaggcagattgtgggtagtaggcttcccaactttaccgaggaagaagccgcactcgttgccggttcatatgattttcttggtctcaactattatgttactcagtacgcccagccacaacctaacccatatccttcagagacacacactgccatgatggacgctggagtaaagctcacatgtaccactctgtttccactttgttacaacctcctttctatatatatattcctttttgttataaaacatacttaatttgtgagtgaccataagttatttcttccttgtgtttacagataataactcacgtggtgaatatcttggtccactggtaattatgcatgatccatcctcatgatatctctctcattgatatgtatattttgttctgattgatatgtattttttgtttgcttccctttcccagttcgctgaagacaaaatagccggcaacagctattactacccaaaaggaatatattacgtaatggacttcttcaaaaccaattacagcaaccctttaatctatatcaccgagaacggtgagttctacatactacttactactcatctattctacataaattaattagtgtatttttatatattagtcgaggaaactgattttcaaatattgtggaatgttttcacggtttaattaggaataagttcgcccggtacagaaaaccgttgcgaagctattgccgattccaagcgcattgattatctctgcagtcatctatgttttctccgtaaggtcatcaagtaagtggatg

SEQ ID NO: 75 - DNA, 2321 bp, Brassica juncea
atgaagcttcatggactagccttgataggttttctaattgctgcggcgagttgcaaagctattgaggacattaattgccaagagaacgagcctttcacatgtggaaacactgatcagttaagcagtaaaattttcccaaaagacttcattttcggtgttgcttctgctgcttaccaggcatgttacaaatcaacaatttttgacgtagaaaaccatttaaaatattaaatccaacgttgcatggttgtttcttattattgtaggtggaagggggcagaggacgtggtcttaacgtttgggatggcttcactcaccgatacccaggtatatcatctacatggtacatatatatataatgtccacatctcttatatatcattcgtagtaatgtatatgtttactatcagagaagggtggatccgatctcgggaatggagacactacttgtgagtcatatacaagatggcaggttaattcctcactgagtcatataggaaaatggcaggttaattccacattcctcactatatataaatgatatccgagtgtgtatgtaaactgcgcagaaagatatagacatcatggacgagctcaatgctactggctacagattctcttttgcgtggtcaagaatcattccaagtatgaacacataaacgatctatttatacaaaaaattctcgtaaattgattgtgagtgttgagaagattaaatatatgatatgtatacatgagcagaaggaaaggtgagtaggggagtgaacaaaggaggtctcgaatactaccacaaactcatagatggtctcgtcgcaaagaatataacaccttttgttaccctctatcactgggacctacctcaaacactgcaagatgagtatgaaggtttcttgaaccgcaccatcatgtatgtcatttgtgccgcgttcttagcaagaaatataagaagaaaaacatatataagtgatctcatgttaatgatttgtttctatgctatgcacagagatgactttagagattatgcggatctatgtttcaaggaatttggtggaaaggtgaagaactggatcacgattaaccagctgtacacagtgcctacgagaggctatgcaatcggaacagatgcacccggtcgatgttctccgaaggttgatgagagatgttacggcggaaattcttcaacagaaccttatatagttgcacataaccagcttcttgctcatgctgcggcggtcgatgtttacaggacaaaatataaggtgagtatatataggtttgtaaataggtgtagtctaacatatatgtcaatgttctaatcatatcatttcatttcgtatgccgtgacaaacagttccaaggagggaagatcggaccagtgatgataactagatggtttcttccatttgatgagactgataaagctagcctatatgcagctgataggatgaaagaattcttcttgggatggtacgtatttgtatgtatatgtacacaaaaatgatatgattatttatacgtatgtacatcgatcaggttcatggagccgctaacaaagggtagatacccagacatcatgagacaaattgtgggtagtcggcttcccaatttcacggaagcagaagcagaactagttgcgggttcatatgattttcttggtctcaactactacaccactcagtatgcccagccaaaacctaacccagttacatgggaaaatcacactgccatgatggacccaggcgcaaagctcacatgtaccactcagtttcctcttatagttacaacctttctatatatatatatatatatataggcttctaagtcttttaaattaagcatatatatactttgtgagtgaccactaattatttcatcattgggtttacagatacgaattcacgtggtgaaaatcttggtccactggtatatgcatgatccacccctgacccctgttacttattattttttttctttctagttgatgtgtatacgtatgcttccttttctcagttcgttaaggacgaaataaacggcgactcctattactacccaaaaggcatttattacgttatggactacttcaaaaccaaataccgtaaccctttgatctatatcactgaaaacggtgactactactcatctctttttccatattaagcaaatatgtatgtttaaaataatgtacaagttgtttatgtaccatgatggttaaattaggatttagtactcccggtgaagaaacccgtgaggaagctattgctgattccaagcggatcgattatctctgcagtcatctatgttttctccgtaaggtcatcaggtga

SEQ ID NO: 76 - DNA, 2459 bp, Brassica juncea
atgaagcttcttcatggactcgctttagtttttctattagctgctgcgagttgcaaagctgatgaagaaattacttgcgaagagaacaatccattcacttgtagtaacactgatattttaagcagtaagaacttcggaaaagatttcatcttcggtgttgcatcttctgcttaccaggcatgtagcaaatgttgtcacaccctaattttgaaataaaatttaaaacactaaaatgcaactttgcatggttgcctcttttcatttcagatcgaaggagggagaggtcgtggtgttaacgtttgggatggcttcagtcaccgatacccaggtatgtcgtttgcacggtgacatctattttatatgtgagaggaatgttggttacatatacacatattaatgtatttgtaatttaatatcagagaaagctgggtcagatttgaagaatggagacactacttgtgagtcatatacgagatggcaggttaatttctcagtacattgatactcatgactgaactatagtatgtataaaaactatacgtgtggattgacatgagattaaaattaatatgtaaactgcagaaagatgtagacgtgatgggcgaactcaatgctactggctacagattctcctttgcgggggcaagaatcattccaagtatgtacatattatcgatcaattatatatatatatatatatataaatatatattattttttttaattgggatgatttagttggaagagtactaattaaagtacgatgtatatatacatgagcagaaggaaaggtgagtaggggagtgaaccaaggaggccttgattactaccacaaactcatagatgcactcctcgaaaaaaatataacgcctttcgttaccctctttcactgggatcttcctcaaacactccaagatgagtatgaaggtttcttggaccgccagatcatgtatgtgccatccttcttaattatatctgaagagagtaaatataattagtgatagaagaagaatatttggtttaatttacatgtattactgaaatgattctatactaatatgcacagccaagatttcaaagattacgcggatctatgtttcaaagaatttggtggaaaggtaaagcattggatcacgatcaaccagctatacacagtgcctacaagaggctatgcgatcggaacagatgcacccggtcgatgttctcctatggttgataccaagcacaggtgttacggcggaaattcttcaacagaaccctacatcgttgcacataaccagcttcttgctcatgccacggtcgtcgatctttacaggaccaaatataaggtgagtggcctccatatgtgaaaaggtggtctaaatctaacatatccgattctaatgtatagtcatatatatatcacgtgatgaacagttccaaaaagggaagattggacctgtgatgataactagatggtttcttccatatgatgaatctgatcctgcctccatagaagcagctgagaggatgaaccaattcttccatggatggtatatataattttatatattaccaaaaatgtatcagtttgtattttatgtattataatgaaacaaaaatatacttggatcaggtatatggagccgttaacaaagggtagatacccagacatcatgaggcagattgtgggtagtcggcttcccaacttcaccgaggaagaagcggaactcgttgctggttcatatgattttcttggtctcaactattacgtcactcagtacgcccagccaaaaccgaacccatatccttcagagacacacactgccatgatggacgctggcgtaaagctcacatgtactacaacattaccacttagttacaagctttctatatacatatatatatgtgctatctcctttttgttacaacatactttctgagtgaccatcaattatttcatccttgtgtttacagatgataattcacgtggtgaatttcttggtccactggtatatataaatgatcatccacccctttgatttctctttcaatttttttttctatttgcaatataacaccactttctccttgttaatatgtatatatatgtttgcttcctttctcagttcgttgaagacaaagtcaacggcaacagctattactacccaaaagggatttattacgtaatggactacttcaaaaccaaatacggcgacccattaatctatgtcaccgagaatggcgagttctacatacttccactactcatattttcatatataacatatcgtaattagtgtatttcgaaataaatccaagaaactgattttcaaatattgtatactttttcatgttatggcggttaattaggatttagtacccccagttcagaaaaccgtgagcaagctattgccgattacaagcgaattgattatctgtgcagtcatctatgttttctccgcaaggtcatcaagtga

SEQ ID NO: 77 - DNA, 2384 bp, Brassica juncea
atgaagcatctttggttcgcattagcttttctattagctttggcgatttgcaaagctgatgaagaaattacctgcgaagagaacctgccattcacatgtggtcaaactgatcgtttcaacagtagcagtttcgagaaagacttcatcttcggtcttgcatcttctgcttaccaggcatgtaacatatgctacatatcaaccattagtattatgttgccagacgtcatattaatttaacgtataaataacatcatatacgaacattaaaatccaacgttgcatggttgtttcgtttcatttcagatcgaaggtagcataaatcgtggacttaacgtttgggatggcttcactcaccgattcccacgtttgttttttgcattactcatcacatatgcatattatctcggttacatgtctccacgcacttatagtactgtatttgtttactatcagataaagcaggacccgatcatggaaatggagacactacttgtaactcatattcatactgggaggtaattaaattcctctatatgaatatgtgtgtgctaactaatattactcactgaattatctatcaactgccaacctagtgtggattgacatgcgattgtatgtgaactgcagaaagatatagaggtgatggacgaactcaaagctactggctacagattctccattgcctggtcaagaatcattccaagtatgtgaacgttattgatttatgtatatatatatatatatcatatatggtaatattcgattgtgattctttggaaagattatatattacgatacatatgagcaggaggaaagaggagcaggggagtacaccaaggaggtattaactactaccacggactcataaatggcctcatcgaaaagggtataacgcctttagttacgctctttcactgggaccttcctcaagtactacaagatgattatgaaggtttcttagacccccagatcatgtatgttaattatatttatggcatactgcttattaagaaagacgataatatatagatatttgttcttggattaatgaaatgattctataatactcgcagagatgatttcagagattacgcggatctatgtttcgaagaatttggtgacaaagtaaagcactggttcacaatcaaccagctctactcagtgcctacgagaggctatggattaggatcagatgcacctggtcgatgttctccaaaggttgatcctacatgttacgccggaaattcttcaacggaaccctatatcgttgcacataaccagctccttgctcatgccagggtggtcgatctttacaggacaaaatataaggtagattaattctccattttgtgaaaggtgtattctaacatatctgattctaaattaatcatatcactgtgtatatttatctgcgtgaccacagcatcaaggaggtaagattggacctgtgatgataactagatggtttcttccatataatgacactgatcaagacagcatagctgcaaccgagaggatgaaagaattcttcttgggatggtaaatgcttataaaatgaaattatattcttaacattaatatatgttgtatttatgaactgacgaaaaatatgtatttatgtacaccaggttcatggggcctctaacaaatggtacataccctcaaatcatgatagacactgtgggtgagcggcttccatccttcactccagaggaatccaaactcgtaaagggttcatatgattttcttggtctcaactattacttcagtcagtatgtccaaccaagtcctaatcgtgttgattgggatcgtcacattgccatgatggacgctggcacaaagctcacatgtatccatctatatatatttcgacttatttacaaccttaatttgccttttgttaagtacaataatttgtgaccatcaattatttgtgttaacagatcgtaatgcaagtaatcatctcattggtccagtggtatatatgcatccatccctattctttcatttttttctaagcaaaattcagttttctgatactatttcgcttctctttctaagttcgctgaacacagggaagacgagaccagaaacatctattactacccaaaaggcatttattatgtgatggattacttcaaaaccaagtacaataaccctttaatctatataaccgagaacggtgggttctactactctatctctaaattcatctctacatgttaaatgtaatttgaaatttgttgaaatgatttcatgttatgacggtttaactaggaatccttacctccggtgatgaaacccgtgaggaggctaagtttgattacagacggattgattatctctgcagtcatctctgttttctcagtaaagtcatcaagtga

SEQ ID NO: 78 - DNA, 2384 bp, Brassica juncea
atgaagcatctttggttcgcattagcttttctattagctttggcgatttgcaaagctgatgaagaaattacctgcgaagagaacctgccattcacatgtggtcaaactgatcgtttcaacagtagcagtttcgagaaagacttcatcttcggtcttgcatcttctgcttaccaggcatgtaacatatgctacatatcaaccattagtattatgttgccagacgtcatattaatttaacgtataaataacatcatatacgaacattaaaatccaacgttgcatggttgtttcgtttcatttcagatcgaaggtagcataaatcgtggacttaacgtttgggatggcttcactcaccgattcccacgtttgttttttgcattactcatcacatatgcatattatctcggttacatgtctccacgcacttatagtactgtatttgtttactatcagataaagcaggacccgatcatggaaatggagacactacttgtaactcatattcatactgggaggtaattaaattcctctatatgaatatgtgtgtgctaactaatattactcactgaattatctatcaactgccaacctagtgtggattgacatgcgattgtatgtgaactgcagaaagatatagaggtgatggacgaactcaaagctactggctacagattctccattgcctggtcaagaatcattccaagtatgtgaacgttattgatttatgtatatatatatatatatcatatatggtaatattcgattgtgattctttggaaagattatatattacgatacatatgagcaggaggaaagaggagcaggggagtacaccaaggaggtattaactactaccacggactcataaatggcctcatcgaaaagggtataacgcctttagttacgctctttcactgggaccttcctcaagtactacaagatgattatgaaggtttcttagacccccagatcatgtatgttaattatatttatggcatactgcttattaagaaagacgataatatatagatatttgttcttggattaatgaaatgattctataatactcgcagagatgatttcagagattacgcggatctatgtttcgaagaatttggtgacaaagtaaagcactggttcacaatcaaccagctctactcagtgcctacgagaggctatggattaggatcagatgcacctggtcgatgttctccaaaggttgattctacatgttacgccggaaattcttcaacggaaccctatatcgttgcacataaccagctccttgctcatgccagggtggtcgatctttacaggacaaaatataaggtagattaattctccattttgtgaaaggtgtattctaacatatctgattctaaattaatcatatcactgtgtatatttatctgcgtgaccacagcatcaaggaggtaagattggacctgtgatgataactagatggtttcttccatataatgacactgatcaagacagcatagctgcaaccgagaggatgaaagaattcttcttgggatggtaaatgcttataaaatgaaattatattcttaacattaatatatgttgtatttatgaactgacgaaaaatatgtatttatgtacaccaggttcatggggcctctaacaaatggtacataccctcaaatcatgatagacactgtgggtgagcggcttccatccttcactccagaggaatccaaactcgtaaagggttcatatgattttcttggtctcaactattacttcagtcagtatgtccaaccaagtcctaatcgtgttgattgggatcgtcacattgccatgatggacgctggcacaaagctcacatgtatccatctatatatatttcgacttatttacaaccttaatttgccttttgttaagtacaataatttgtgaccatcaattatttgtgttaacagatcgtaatgcaagtaatcatctcattggtccagtggtatatatgcatccatccctattctttcatttttttctaagcaaaattcagttttctgatactatttcgcttctctttctaagttcgctgaacacagggaagacgagaccagaaacatctattactacccaaaaggcatttattatgtgatggattacttcaaaaccaagtacaataaccctttaatctatataaccgagaacggtgggttctactactctatctctaaattcatctctacatgttaaatgtaatttgaaatttgttgaaatgatttcatgttatgacggtttaactaggaatccttacctccggtgatgaaacccgtgaggaggctaagtttgattacagacggattgattatctctgcagtcatctctgttttctcagtaaagtcatcaagtga

SEQ ID NO: 79 - DNA, 1374 bp, Brassica juncea
atgaagcatctttggctcacattagcttttctattggctttggcaacttgcaaagctgatgaagaaattacttgcgaagagaacctgccattcacatgtggtcaaactgatcgtttcaacagtagcagtttcgagaaagacttcatcttcggtcttgcatcttctgcttaccagatcgaaggtagcataaatcgtggagttaacgtttgggatggcttcactcaccgattcccagataaagcaggacccgatcatggaaatggagacactacttgtaactcatattcgtactgggagaaagatatagaggtgatggatgaactcaaagctactggctacagattctccattgcctggtcaagaatcattccaggaggaaagaggagcaggggagtacaccaaggaggtattaactactaccacggactcataaatggcctcatcgaaaagggtataacgcctttagttacgctctttcactgggaccttcctcaagtactacaagatgaatatgaaggtttattggaccctcagatcgatgatttcagagatttcgcggatctatgttttgaagaatatggtgataaagtaaagcactggttcacaatcaaccagctctactcagtgcctacgagaggctatggattaggatcagatgcacctggtcgatgttctccaaaggttgattctacatgttacgccggaaattcttcaacggaaccctatattgttgcacataaccagctccttgctcatgccacggtggtcgatctttacaggacaaaatataagcatcaaggaggtaagattggacctgtgatgataactagatggtttcttccatataatgacactgatccagactccatagctgcaaccgagaggatgaaagaattcttcttgagatggtacatggggccgctaacaaatggtacataccctcaaatcatgatagacactgtgggtgagcggctaccatcgttcactccagaggaatccaaactcgtaaagggttcatatgattttcttggtctcaactattacttcactcagtatgtccagccaagtcctaatcatgttgattcggatggtcacactgccatgatggacgctggcacaaggctcacagatcgtaatgcaagtaatcatgccattggcccagtggagaccaaaaacacctattactacccaaaaggcatttattatgtgatggatcacttcaaaaccaattacaatgaccctgtaatctatataaccgagaacctaggattcagtacctccggtgatgaaacccgtgaggaggctaagtttgattacaggcggattgattatctctgcagtcatctctgtttcctcagtaaagtcatcaagtga

SEQ ID NO: 80 - DNA, 1383 bp, Brassica juncea
atgaagcttcttcatggactcgctttagtttttctattagctgctgcgagttgcaaagctgatgaagaaattacttgcgaagagaacaatccattcacatgtagtaacactgatattttaagcagtaaaaacttcggaaaagacttcatcttcggtgttgcatcttctgcttaccagatcgaaggaggaagaggtcgtggtgttaacatttgggatggcttcagtcaccgatatccagagaaatcagggtcagatttgaagaatggagacactacttgtgagtcatatacgagatggcagaaagatgtagacgtgatgggcgaactcaatgctactggctacaggttctcctttgcgtggtcaagaatcattccagaaggaaaggtgagtaggggagtgaaccaaggaggtcttgattactaccacaaactcatagatgcactactcgaaaagaatataacgcctttcgttaccctctttcactgggaccttcctcaaacactccaagatgagtatgaaggtttcttagaccgccagatccaagatttcaaagactacgcggatctatgtttcaaagaatttggtggaaaggtaaagcactggatcacgatcaaccagctatacacagtccctacgagaggctatgcggtcggaacagatgcacccggtcgatgttctcctatggttgataccaagcacaggtgttacggtggaaattcttcaacagaaccctacatcgttgcacataaccagcttcttgctcatgccacggtcgtcgatctttacaggaccaaatataagtttcaaaaagggaagattggacctgtgatgataacaagatggtttcttccatttgatgagtctgatcctgcctccatagaagcagctgagaggatgaaccaattctttcatggatggtacatggagccgctaacaaagggtagatacccagacatcatgaggcagattgtgggtagtaggcttcccaactttaccgaggaagaagcccaactcgttgccggttcatatgattttcttggtctcaactattacgtcactcagtacgcccagccaaaacctaacccatatccttcagagacacacactgccatgatggacgctggcgtaaagctcacagatgataactcacgtggtgaatttcttggtccactggtaaacggcaacagctattactacccaaaaggcatttactacgtaatggactacttcaaaaccaaatacggagaccctttaatctatgtcaccgagaacttaggatttagtacccccagtgaagaaaaccgtgagcaggctattgccgattacaagcgaattgattatctctgcagtcatttatgttttctccgcaaggtcatcaagtga

SEQ ID NO: 81 - DNA, 1383 bp, Brassica juncea
atgaagcttcttcatggactcgctttagtttttctattagctgctgcgagttgcaaagctgatgaagaaattacttgcgaagagaacaacccattcacatgtagtaacactgatattttaagcagtaagaacttcggaaaagatttcatcttcggtgttgcatcttctgcttaccagattgaaggagggagaggtcgtggtgttaacgtttgggatggcttcagtcaccgatacccagagaaatcagggtcagacttgaagaatggagacactacttgtgagtcctatacgagatggcagaaagatgtagacgtgatgggcgaactcaatgctactggctacaggttctcctttgcgtggtcaagaatcattccagaaggaaaggtgagtaggggagtgaaccaaggaggtcttgattactaccacaaactcttagatgcactcctcgaaaagaatataacgcctttcgttaccctctttcactgggaccttcctcaaacactccaagatgagtatgaaggtttcttggaccgccagatccaagatttcaaagattacgcggatctatgtttcaaagaatttggtggaaaggtaaagcactggatcacgatcaaccagatatacacagtccctacgagaggctatgcggtcggaacagatgcacccggtcgatgttctcctatggttgataccaagcacaggtgttacggtggaaattcttcaacagaaccctacatcgttgcacataaccagcttcttgctcatgccacggtcgtcgatctttacaggaccaaatacaagttccaaaaagggaagattggacctgtaatgattacaagatggtttcttccatttgatgagtctgatcctgcctccatagaagcagctgagaggatgaaccaattcttccatggatggtacatggagccgctaacaaagggtagatacccagacatcatgaggcagattgtgggtagtaggcttcccaacttcaccgaggaagaagcagaactcgttgctggttcatatgattttcttggtctaaactattacgtcacccaatacgcccagccaaaacctaacccatatccttcagagacacacactgccatgatggacgctggcgtaaagctcacagatgataattcacgtggtgaatttcttggtccactggtaaacggcaacagctattactacccaaaaggcatttattacgttatggactacttcaaaaccaaatacggcgaccctttaatctatgtcaccgaaaatttaggatttagtacccccagttcagaaaaccgtgagcaagctattgccgactacaagcgaatcgattatctatgcagccatctatgttttctccgcaaggtgatcaagtga

SEQ ID NO: 82 - DNA, 1383 bp, Brassica juncea
atgaagcttcttcatggactcgctttagtttttctattagctgctgcgagttgcaaagctgatgaagaaattacttgcgaagagaacaatccattcacatgtagtaacactgatattttaagcagtaaaaacttcggaaaagacttcatcttcggtgttgcatcttctgcttaccagatcgaaggaggaagaggtcgtggtgttaacatttgggatggcttcagtcaccgatatccagagaaatcagggtcagatttgaagaatggagacactacttgtgagtcatatacgagatggcagaaagatgtagacgtgatgggcgaactcaatgctactggctacaggttctcctttgcgtggtcaagaatcattccagaaggaaaggtgagtaggggagtgaaccaaggaggtcttgattactaccacaaactcatagatgcacttctcgaaaagaatataacgcctttcgttaccctctttcactgggaccttcctcaaacactccaagatgagtatgaaggtttcttagaccgccagatccaagatttcaaagactacgcggatctatgtttcaaagaatttggtggaaaggtaaagcactggatcacgatcaaccagctatacacagtccctacgagaggctatgcggtcggaacagatgcacccggtcgatgttctcctatggttgataccaagcacaggtgttacggtggaaattcttcaacagaaccctacatcgttgcacataaccagcttcttgctcatgccacggtcgtcgatctttacaggaccaaatataagtttcaaaaagggaagattggacctgtgatgataacaagatggtttcttccatttgatgagtctgatcctgcctccatagaagcagctgagaggatgaaccaattctttcatggatggtacatggagccgctaacaaagggtagatacccagacatcatgaggcagattgtgggtagtaggcttcccaactttaccgaggaagaagccttactcgttgccggttcatatgattttcttggtctcaactattatgttactcagtacgcccagccaaaacctaacccatatccttcagagacacacactgccatgatggacgctggcgtaaagctcacagatgataactcacgtggtgaatttcttggtccactggtaaacggcaacagctattactacccaaaaggcatttactacgtaatggactacttcaaaaccaaatacggagaccctttaatctatgtcaccgagaacttaggatttagtacccccagtgaagaaaaccgtgagcaggctattgccgattacaagcgaattgattatctctgcagtcatttatgttttctccgcaaggtcatcaagtga

SEQ ID NO: 83 - DNA, 1380 bp, Brassica juncea
atgaagcttcttgggctcgctttagtttttctgttagcttctgcgagttgcaaagctgacgaagaaattacttgtgaagagaacaatccattcacatgtagtaacactgatattttaagcagtaaaaacttcggaaaagacttcatcttcggtgttgcatcttctgcttaccagatcgaaggagggagaggtcgtggtgttaacatttgggatggcttcagtcaccgatacccagagaaatcagggtcagatttgaagaatggagacactacttgtgagtcatatacgagatggcagaaagatgtagacgttatgggcgaactaaatgctactggctacagattttcctttgcgtggtcgagaatcattccagaaggaaaggtgagtaggggagtgaaccaaggaggtcttgattactaccacaaactcatagacgccctcctcgaaaagaatataactcctttcgttaccctctttcactgggaccttcctcaaacactccaagatgagtacgaaggtttcttggaccgccagatccaagatttcaaagattatgccgatctatgtttcaaagaatttggtggaaaggtaaagcactggatcacgatcaaccagctatacacagtccctacgagaggctatgcagtcggaacagatgcacccggtcgatgttctcctatggttgatactaagcacaggtgttacggcggaaattcttcaacagaaccctatatcgttgcacataaccagcttcttgctcatgccacggtcgtcgatctttacaggaccaaatataagttccaaaaagggaagattggacctgtgatgataacaagatggtttcttccatttgatgagtctgatccggcctccatagaagcagctgagaggatgaaccaattcttccatggatggtacatggagccgctaacaaagggtagatacccagacatcatgaggcagattgtgggtagtaggcttcccaactttaccgaggaagaagccaaactcgttgccggttcatatgattttcttggtctcaactattacgtcactcagtacgcccagccaaaacctaacccatatccttcagagacacacactgccatgatggacgctggtgtaaagctcacagatgataattcgcgtggtgaatttcttggtccactggataacggaaacagctattactatccaaaaggaatttattacgtgatggactacttcaaaaccaactacggcaaccctttaatctatgtcaccgagaacttaggatttagtacgcccagttcagaaaaccgtgagcaggctattgcggattacaagcgaattgattatctctgcagtcatctatgttttctccgtaaggtcatcaagtaa

SEQ ID NO: 84 - DNA, 1383 bp, Brassica juncea
atgaagcttcttcatggacttgctttagttttcctattagctgcttcgagttgcaaagctgatgaagaaattacatgtgaagagaacactccattcacatgtggtaacactgatattttaagcagtaaaaactttggaaaagacttcatcttcggtgttgcatcttctgcttaccagatcgaaggagggagaggtcgtggtgttaacatttgggatggcttcagtcaccgatacccagagaaatcagggtcagatttgatgaatggagacactacttgtgagtcatatacgagatggcagaaagatgtagacattatgggagaactcaatgctactggctacagattctcctttgcgtggtcaagaatcattccagaaggaaaagtgagtaggggagtgaaccaaggaggtcttgattactaccaccaactcatagacgccctcctagaaaagaatataacgcctttcgttaccctcttccactgggaccttcctcaaacactccaagatgagtatgaaggtttcttagaccgccagatccaagatttcaaagattacgcggatctatgtttcaatgaatttggtggaaaggtaaagcactggatcacgatcaaccagctatatacagtgccgacaagaggctatgcgagcggaacagatgcacccggtcgatgttcttatatggttgataccaagcacaggtgttacggcggaaattcttcaacagaaccctacatcgttgcacataaccagcttcttgctcatgccgcagttgtcgatctttacaggaccaaatataagttccaaaacgggaagattggacctgtgatgataacaagatggtttcttccatttgatgagtctgatcctgcttgcgtagaagcagctgagaggatgaaccaatttttccatggatggtacatggagccgctaacaaagggtagatacccagacatcatgaggcagatcgtgggtagtaggctccccaactttaccgaggaagaagccgcactcgttgctggttcatatgattttcttggtctcaactattacgtcactcagtacgcccagccacaacctaacccatatccttcagagacacacactgccatgatggaccctggtgtaaagctcacagataataattcacgtggtgaattacttggtccactggttaacggcaacagctattactacccaaaaggaatgtattacgtaatggacttcttcaaaaccaattacagcaaccctttaatatatatcaccgagaacttaggaattagttcgcccggtacagaaaaccgttgcgaagctattgccgattacaagcgaatcgattatctctgcagtcatctctgttttctccgtaaggtcatcaggtaa

SEQ ID NO: 85 - DNA, 1383 bp, Brassica juncea
atgaagcttcttcatggactcgctttagtttttctattagctactacgagttgcaaagcagatgaagaaattacttgcgaagagaacaatccattcacctgtagtaacactgatatattaagcagtaagaacttcggaaaaaatttcatcttcggtgttgcatcttctgcttaccagatagaaggagggagaggtcgtggtgttaacgtttgggatggcttcagtcaccggtacccagagaaagctgggtcagatttgaagaatggagacactacttgtgagtcatatacgagatggcagaaagatgtagacgtgatgggcgaaatcaatgctactggctacagattctcctttgcatggtcaagaatcattccagaaggaaaggtgagtaggggagtgaaccaaggaggtcttcaatactaccacaaactcatagatgcactcctggaaaagaatataacgcctttcgttaccctctatcactgggaccttcctcaaacactccaagatgagtatgaaggtttcttggaccgccagatccaagatttcaaagattacgcggatctatgtttcaaagaatttggtggaaaggtaaagcactggatcacaatcaaccagctatacacagtgcctacgagaggctatgcactcggaacagatgcacccggtcgatgttcttatatggttgataacaagcacaggtgttatggcggaaattcttcaacagaaccctatatcgttgcacataaccagcttcttgctcatgccacgatcgtcgatctttacaggaccaaatataagttccaaaaagggaagattggacctgtgatgataactagatggtttcttccatatgatgagtctgatccttcttgcgtagaagcagctgagaggatgaaccaattcttccatggatggtacatggagccgctaacaaagggtagatacccagacatcatgaggcagattgtgggtagtaggctccccaacttcactgaagctgaagccgaactcgttgctggttcatatgattttcttggtctcaactattacgtcactcagtatgcccagccgaaacctaacccatatccttcagagacacacactgccttgatggacgctggcgtaaagctcacagatgataattcacgtggtgaattccttggtccactggacaacggcaacagctattactacccaaaagggatttattacgtaatggactacttcaaaaccaaatacggtgacccattaatctatgtcaccgagaatttaggatttagcacgcccactacagaaaaccgtggcgaagctattgccgattacaagcgaattgattatctttgcagtcatctatgttttctccgtaaggtcatcaagtga

SEQ ID NO: 86 - DNA, 1383 bp, Brassica juncea
atgaagcttcttcgtcgactcgctttagtttttctattagctgctgcgagttgcaaggctgatgaagaaattacttgcgaagagaacaatccatttacttgtagtaacactgatattttaagcagcaagaacttcggaaaagatttcatctttggtgttgcgtcttctgcttaccagattgaaggagggagaggtcgtggtgttaatgtttgggatggtttcagtcaccggtacccagagaaagctgggtcagatttgaagaatggagacactacttgtgagtcatatacgagatggcagaaagatgtagacgtgatgggcgaaatcaatgctactggctacagattctcctttgcatggtcaagaatcattccagaaggaaaggtgagtaggggagtgaaccaaggaggtcttgattattaccaccaactcatagatgcactcctcgaaaagaatataacgcctttcgtaaccctctttcactgggaccttcctcaaacactccaagatgagtatgaaggtttcttggaccgccagatccaggatttcaaagattacgcggatctatgtttcaaagaatttggtggaaaggtaaagcattggatcacgatcaaccagctatacacagttcctacaagaggctatgcagtcggaacagatgcacccggtcgatgttctcctatggttgataccaaacacaggtgttacggcggaaattcttcaacagaaccctacatcgttgcacataaccagcttcttgctcatgccacggtcgtcgatctttacaggaccaaatataagttccaaaacgggaagattggacctgtgatgataacaagatggtttcttccatatgatgagtctgatcctgcctgcatagaagcagctgagaggatgaaccaattcttccatggatggtacatggagccgctaacgaagggtagatacccagacatcatgaggcaaattgtgggtagtaggcttcccaactttaccgaggaagaagccgcactcgttgccggttcatatgattttcttggtctcaactattatgtcactcagtacgcccggccacaacctaacccatatccttcagagacacacactgccatgatggacgctggagtaaagctcacagatgataattcacgtggtgaaatacttggtccactggttaatggcaacagctattactacccaaaaggaatttattacgtaatggactttttcaaaaccaattacagcaaccctttaatctatatcaccgagaacttaggaattagttcgcccagtacagaaagccgttgtgaagctattgccgattacaagcgaattgattatctctgcagtcatctatgttttctccgtaaggtcatcaagtga

SEQ ID NO: 87 - DNA, 1377 bp, Brassica juncea
atgaagattcttcatggactcgctttagtttttctattagctattgcgagttgcaaagcttatgaagaaattacttgcgaacagaacgaaccattcacatgtggtaacactgatatcttaagcagtaaaaacttcggagaagacttcatcttcggtgttgcatcttctgcgtaccagatcgaaggagggagaggtcgtggtgttaacgtttgggatggtttcagtcaccgatacccagagaaatcagggtcagatttgctgaatggagacacttcttgtgagtcatatacgagatggaagaaagatgtagagattatgggagaactcaatgctactggctacagattctccttagcgtggtcaagaatcattccagaaggaaaggtgagtaggggagtgaaccaaggaggtcttgattactaccaccaactcatagacgccctcctcgaaaagaatataactcctttcgttaccctctttcactgggaccttcctcaaacactccaagatgagtatgaaggttttttggatcgccagatccaagatttcaaagactatgcggatctatgtttcaaagaatttggtggaaaggtaaagcactggatcacgatcaaccagctattcacagtgcctacgagaggctatgcactcggaacagatgcacccggtagatgttctcctatgattgatgagaggtgttacggcggaaactcttcaacagaaccctatattgttgcacataaccagcttctcgctcatgctgcggtcgtcgatctttacaggaccaactataaggaccaacaagggaagattggacctgtgatgataacaagatggtttcttccatatgatgagtctgatcccgcttgcgtagaagcagctgagaggatgaaccaattcttccatggatggcacatggagccgctaacaaagggtagatacccagacatcatgaggcagattgtgggtagtaggcttcccaactttaccgaggaagaagccgcactcgttgccggttcatatgattttcttggtctcaactattatgttactcagtacgcccagccacaacctaacccatatccttcagagacacacactgccatgatggacgctggagtaaagctcacagataataactcacgtggtgaatatcttggtccactgatagccggcaacagctattactacccaaaaggaatatattacgtaatggacttcttcaaaaccaattacagcaaccctttaatctatatcaccgagaacttaggaataagttcgcccggtacagaaaaccgttgcgaagctattgccgattccaagcgcattgattatctctgcagtcatctatgttttctccgtaaggtcatcaagtaa

SEQ ID NO: 88 - DNA, 1377 bp, Brassica juncea
atgaagcttcatggactagccttgataggttttctaattgctgcggcgagttgcaaagctattgaggacattaattgccaagagaacgagcctttcacatgtggaaacactgatcagttaagcagtaaaattttcccaaaagacttcattttcggtgttgcttctgctgcttaccaggtggaagggggcagaggacgtggtcttaacgtttgggatggcttcactcaccgatacccagagaagggtggatccgatctcgggaatggagacactacttgtgagtcatatacaagatggcagaaagatatagacatcatggacgagctcaatgctactggctacagattctcttttgcgtggtcaagaatcattccagaaggaaaggtgagtaggggagtgaacaaaggaggtctcgaatactaccacaaactcatagatggtctcgtcgcaaagaatataacaccttttgttaccctctatcactgggacctacctcaaacactgcaagatgagtatgaaggtttcttgaaccgcaccatcgatgactttagagattatgcggatctatgtttcaaggaatttggtggaaaggtgaagaactggatcacgattaaccagctgtacacagtgcctacgagaggctatgcaatcggaacagatgcacccggtcgatgttctccgaaggttgatgagagatgttacggcggaaattcttcaacagaaccttatatagttgcacataaccagcttcttgctcatgctgcggcggtcgatgtttacaggacaaaatataagttccaaggagggaagatcggaccagtgatgataactagatggtttcttccatttgatgagactgataaagctagcctatatgcagctgataggatgaaagaattcttcttgggatggttcatggagccgctaacaaagggtagatacccagacatcatgagacaaattgtgggtagtcggcttcccaatttcacggaagcagaagcagaactagttgcgggttcatatgattttcttggtctcaactactacaccactcagtatgcccagccaaaacctaacccagttacatgggaaaatcacactgccatgatggacccaggcgcaaagctcacagatacgaattcacgtggtgaaaatcttggtccactgataaacggcgactcctattactacccaaaaggcatttattacgttatggactacttcaaaaccaaataccgtaaccctttgatctatatcactgaaaacttaggatttagtactcccggtgaagaaacccgtgaggaagctattgctgattccaagcggatcgattatctctgcagtcatctatgttttctccgtaaggtcatcaggtga

SEQ ID NO: 89 - DNA, 1383 bp, Brassica juncea
atgaagcttcttcatggactcgctttagtttttctattagctgctgcgagttgcaaagctgatgaagaaattacttgcgaagagaacaatccattcacttgtagtaacactgatattttaagcagtaagaacttcggaaaagatttcatcttcggtgttgcatcttctgcttaccagatcgaaggagggagaggtcgtggtgttaacgtttgggatggcttcagtcaccgatacccagagaaagctgggtcagatttgaagaatggagacactacttgtgagtcatatacgagatggcagaaagatgtagacgtgatgggcgaactcaatgctactggctacagattctcctttgcgggggcaagaatcattccagaaggaaaggtgagtaggggagtgaaccaaggaggccttgattactaccacaaactcatagatgcactcctcgaaaaaaatataacgcctttcgttaccctctttcactgggatcttcctcaaacactccaagatgagtatgaaggtttcttggaccgccagatccaagatttcaaagattacgcggatctatgtttcaaagaatttggtggaaaggtaaagcattggatcacgatcaaccagctatacacagtgcctacaagaggctatgcgatcggaacagatgcacccggtcgatgttctcctatggttgataccaagcacaggtgttacggcggaaattcttcaacagaaccctacatcgttgcacataaccagcttcttgctcatgccacggtcgtcgatctttacaggaccaaatataagttccaaaaagggaagattggacctgtgatgataactagatggtttcttccatatgatgaatctgatcctgcctccatagaagcagctgagaggatgaaccaattcttccatggatggtatatggagccgttaacaaagggtagatacccagacatcatgaggcagattgtgggtagtcggcttcccaacttcaccgaggaagaagcggaactcgttgctggttcatatgattttcttggtctcaactattacgtcactcagtacgcccagccaaaaccgaacccatatccttcagagacacacactgccatgatggacgctggcgtaaagctcacagatgataattcacgtggtgaatttcttggtccactggtcaacggcaacagctattactacccaaaagggatttattacgtaatggactacttcaaaaccaaatacggcgacccattaatctatgtcaccgagaatttaggatttagtacccccagttcagaaaaccgtgagcaagctattgccgattacaagcgaattgattatctgtgcagtcatctatgttttctccgcaaggtcatcaagtga

SEQ ID NO: 90 - DNA, 1374 bp, Brassica juncea
atgaagcatctttggttcgcattagcttttctattagctttggcgatttgcaaagctgatgaagaaattacctgcgaagagaacctgccattcacatgtggtcaaactgatcgtttcaacagtagcagtttcgagaaagacttcatcttcggtcttgcatcttctgcttaccagatcgaaggtagcataaatcgtggacttaacgtttgggatggcttcactcaccgattcccagataaagcaggacccgatcatggaaatggagacactacttgtaactcatattcatactgggagaaagatatagaggtgatggacgaactcaaagctactggctacagattctccattgcctggtcaagaatcattccaggaggaaagaggagcaggggagtacaccaaggaggtattaactactaccacggactcataaatggcctcatcgaaaagggtataacgcctttagttacgctctttcactgggaccttcctcaagtactacaagatgattatgaaggtttcttagacccccagatcgatgatttcagagattacgcggatctatgtttcgaagaatttggtgacaaagtaaagcactggttcacaatcaaccagctctactcagtgcctacgagaggctatggattaggatcagatgcacctggtcgatgttctccaaaggttgatcctacatgttacgccggaaattcttcaacggaaccctatatcgttgcacataaccagctccttgctcatgccagggtggtcgatctttacaggacaaaatataagcatcaaggaggtaagattggacctgtgatgataactagatggtttcttccatataatgacactgatcaagacagcatagctgcaaccgagaggatgaaagaattcttcttgggatggttcatggggcctctaacaaatggtacataccctcaaatcatgatagacactgtgggtgagcggcttccatccttcactccagaggaatccaaactcgtaaagggttcatatgattttcttggtctcaactattacttcagtcagtatgtccaaccaagtcctaatcgtgttgattgggatcgtcacattgccatgatggacgctggcacaaagctcacagatcgtaatgcaagtaatcatctcattggtccagtggagaccagaaacatctattactacccaaaaggcatttattatgtgatggattacttcaaaaccaagtacaataaccctttaatctatataaccgagaacctaggaatccttacctccggtgatgaaacccgtgaggaggctaagtttgattacagacggattgattatctctgcagtcatctctgttttctcagtaaagtcatcaagtga

SEQ ID NO: 91 - DNA, 1374 bp, Brassica juncea
atgaagcatctttggttcgcattagcttttctattagctttggcgatttgcaaagctgatgaagaaattacctgcgaagagaacctgccattcacatgtggtcaaactgatcgtttcaacagtagcagtttcgagaaagacttcatcttcggtcttgcatcttctgcttaccagatcgaaggtagcataaatcgtggacttaacgtttgggatggcttcactcaccgattcccagataaagcaggacccgatcatggaaatggagacactacttgtaactcatattcatactgggagaaagatatagaggtgatggacgaactcaaagctactggctacagattctccattgcctggtcaagaatcattccaggaggaaagaggagcaggggagtacaccaaggaggtattaactactaccacggactcataaatggcctcatcgaaaagggtataacgcctttagttacgctctttcactgggaccttcctcaagtactacaagatgattatgaaggtttcttagacccccagatcgatgatttcagagattacgcggatctatgtttcgaagaatttggtgacaaagtaaagcactggttcacaatcaaccagctctactcagtgcctacgagaggctatggattaggatcagatgcacctggtcgatgttctccaaaggttgattctacatgttacgccggaaattcttcaacggaaccctatatcgttgcacataaccagctccttgctcatgccagggtggtcgatctttacaggacaaaatataagcatcaaggaggtaagattggacctgtgatgataactagatggtttcttccatataatgacactgatcaagacagcatagctgcaaccgagaggatgaaagaattcttcttgggatggttcatggggcctctaacaaatggtacataccctcaaatcatgatagacactgtgggtgagcggcttccatccttcactccagaggaatccaaactcgtaaagggttcatatgattttcttggtctcaactattacttcagtcagtatgtccaaccaagtcctaatcgtgttgattgggatcgtcacattgccatgatggacgctggcacaaagctcacagatcgtaatgcaagtaatcatctcattggtccagtggagaccagaaacatctattactacccaaaaggcatttattatgtgatggattacttcaaaaccaagtacaataaccctttaatctatataaccgagaacctaggaatccttacctccggtgatgaaacccgtgaggaggctaagtttgattacagacggattgattatctctgcagtcatctctgttttctcagtaaagtcatcaagtga

SEQ ID NO: 92 - DNA, 1383 bp, Brassica juncea
atgaagcttcttcatggactcgctttagtttttctattagctgctgcgagttgcaaagctgatgaagaaattacttgcgaagagaacaatccattcacatgtagtaacactgatattttaagcagtaaaaacttcggaaaagacttcatcttcggtgttgcatcttctgcttaccagatcgaaggaggaagaggtcgtggtgttaacatttgggatggcttcagtcaccgatatccagagaaatcagggtcagatttgaagaatggagacactacttgtgagtcatatacgagatggcagaaagatgtagacgtgatgggcgaactcaatgctactggctacaggttctcctttgcgtggtcaagaatcattccagaaggaaaggtgagtaggggagtgaaccaaggaggtcttgattactaccacaaactcatagatgcacttctcgaaaagaatataacgcctttcgttaccctctttcactgggaccttcctcaaacactccaagatgagtatgaaggtttcttagaccgccagatccaagatttcaaagactacgcggatctatgtttcaaagaatttggtggaaaggtaaagcactggatcacgatcaaccagctatacacagtccctacgagaggctatgcggtcggaacagatgcacccggtcgatgttctcctatggttgataccaagcacaggtgttacggtggaaattcttcaacagaaccctacatcgttgcacataaccagcttcttgctcatgccacggtcgtcgatctttacaggaccaaatataagtttcaaaaagggaagattggacctgtgatgataacaagatggtttcttccatttgatgagtctgatcctgcctccatagaagcagctgagaggatgaaccaattctttcatggatggtacatggagccgctaacaaagggtagatacccagacatcatgaggcagattgtgggtagtaggcttcccaactttaccgaggaagaagccttactcgttgccggttcatatgattttcttggtctcaactattatgttactcagtacgcccagccttaacctaacccatatccttcagagacacacactgccatgatggacgctggcgtaaagctcacagatgataactcacgtggtgaatttcttggtccactggtaaacggcaacagctattactacccaaaaggcatttactacgtaatggactacttcaaaaccaaatacggagaccctttaatctatgtcaccgagaacttaggatttagtacccccagtgaagaaaaccgtgagcaggctattgccgattacaagcgaattgattatctctgcagtcatttatgttttctccgcaaggtcatcaagtga

SEQ ID NO: 93 - protein, 457 aa, Brassica juncea
MKHLWLTLAFLLALATCKADEEITCEENLPFTCGQTDRFNSSSFEKDFIFGLASSAYQIEGSINRGVNVWDGFTHRFPDKAGPDHGNGDTTCNSYSYWEKDIEVMDELKATGYRFSIAWSRIIPGGKRSRGVHQGGINYYHGLINGLIEKGITPLVTLFHWDLPQVLQDEYEGLLDPQIDDFRDFADLCFEEYGDKVKHWFTINQLYSVPTRGYGLGSDAPGRCSPKVDSTCYAGNSSTEPYIVAHNQLLAHATVVDLYRTKYKHQGGKIGPVMITRWFLPYNDTDPDSIAATERMKEFFLRWYMGPLTNGTYPQIMIDTVGERLPSFTPEESKLVKGSYDFLGLNYYFTQYVQPSPNHVDSDGHTAMMDAGTRLTDRNASNHAIGPVETKNTYYYPKGIYYVMDHFKTNYNDPVIYITENLGFSTSGDETREEAKFDYRRIDYLCSHLCFLSKVIK

SEQ ID NO: 94 - protein, 460 aa, Brassica juncea
MKLLHGLALVFLLAAASCKADEEITCEENNPFTCSNTDILSSKNFGKDFIFGVASSAYQIEGGRGRGVNIWDGFSHRYPEKSGSDLKNGDTTCESYTRWQKDVDVMGELNATGYRFSFAWSRIIPEGKVSRGVNQGGLDYYHKLIDALLEKNITPFVTLFHWDLPQTLQDEYEGFLDRQIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAQLVAGSYDFLGLNYYVTQYAQPKPNPYPSETHTAMMDAGVKLTDDNSRGEFLGPLVNGNSYYYPKGIYYVMDYFKTKYGDPLIYVTENLGFSTPSEENREQAIADYKRIDYLCSHLCFLRKVIK

SEQ ID NO: 95 - protein, 460 aa, Brassica juncea
MKLLHGLALVFLLAAASCKADEEITCEENNPFTCSNTDILSSKNFGKDFIFGVASSAYQIEGGRGRGVNVWDGFSHRYPEKSGSDLKNGDTTCESYTRWQKDVDVMGELNATGYRFSFAWSRIIPEGKVSRGVNQGGLDYYHKLLDALLEKNITPFVTLFHWDLPQTLQDEYEGFLDRQIQDFKDYADLCFKEFGGKVKHWITINQIYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAELVAGSYDFLGLNYYVTQYAQPKPNPYPSETHTAMMDAGVKLTDDNSRGEFLGPLVNGNSYYYPKGIYYVMDYFKTKYGDPLIYVTENLGFSTPSSENREQAIADYKRIDYLCSHLCFLRKVIK

SEQ ID NO: 96 - protein, 460 aa, Brassica juncea
MKLLHGLALVFLLAAASCKADEEITCEENNPFTCSNTDILSSKNFGKDFIFGVASSAYQIEGGRGRGVNIWDGFSHRYPEKSGSDLKNGDTTCESYTRWQKDVDVMGELNATGYRFSFAWSRIIPEGKVSRGVNQGGLDYYHKLIDALLEKNITPFVTLFHWDLPQTLQDEYEGFLDRQIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEALLVAGSYDFLGLNYYVTQYAQPKPNPYPSETHTAMMDAGVKLTDDNSRGEFLGPLVNGNSYYYPKGIYYVMDYFKTKYGDPLIYVTENLGFSTPSEENREQAIADYKRIDYLCSHLCFLRKVIK

SEQ ID NO: 97 - protein, 459 aa, Brassica juncea
MKLLGLALVFLLASASCKADEEITCEENNPFTCSNTDILSSKNFGKDFIFGVASSAYQIEGGRGRGVNIWDGFSHRYPEKSGSDLKNGDTTCESYTRWQKDVDVMGELNATGYRFSFAWSRIIPEGKVSRGVNQGGLDYYHKLIDALLEKNITPFVTLFHWDLPQTLQDEYEGFLDRQIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAKLVAGSYDFLGLNYYVTQYAQPKPNPYPSETHTAMMDAGVKLTDDNSRGEFLGPLDNGNSYYYPKGIYYVMDYFKTNYGNPLIYVTENLGFSTPSSENREQAIADYKRIDYLCSHLCFLRKVIK

SEQ ID NO: 98 - protein, 460 aa, Brassica juncea
MKLLHGLALVFLLAASSCKADEEITCEENTPFTCGNTDILSSKNFGKDFIFGVASSAYQIEGGRGRGVNIWDGFSHRYPEKSGSDLMNGDTTCESYTRWQKDVDIMGELNATGYRFSFAWSRIIPEGKVSRGVNQGGLDYYHQLIDALLEKNITPFVTLFHWDLPQTLQDEYEGFLDRQIQDFKDYADLCFNEFGGKVKHWITINQLYTVPTRGYASGTDAPGRCSYMVDTKHRCYGGNSSTEPYIVAHNQLLAHAAVVDLYRTKYKFQNGKIGPVMITRWFLPFDESDPACVEAAERMNQFFHGWYMEPLTKGRYPDIMRQIVGSRLPNFTEEEAALVAGSYDFLGLNYYVTQYAQPQPNPYPSETHTAMMDPGVKLTDNNSRGELLGPLVNGNSYYYPKGMYYVMDFFKTNYSNPLIYITENLGISSPGTENRCEAIADYKRIDYLCSHLCFLRKVIR

SEQ ID NO: 99 - protein, 460 aa, Brassica juncea
MKLLHGLALVFLLATTSCKADEEITCEENNPFTCSNTDILSSKNFGKNFIFGVASSAYQIEGGRGRGVNVWDGFSHRYPEKAGSDLKNGDTTCESYTRWQKDVDVMGEINATGYRFSFAWSRIIPEGKVSRGVNQGGLQYYHKLIDALLEKNITPFVTLYHWDLPQTLQDEYEGFLDRQIQDFKDYADLCFKEFGGKVKHWITINQLYTVPTRGYALGTDAPGRCSYMVDNKHRCYGGNSSTEPYIVAHNQLLAHATIVDLYRTKYKFQKGKIGPVMITRWFLPYDESDPSCVEAAERMNQFFHGWYMEPLTKGRYPDIMRQIVGSRLPNFTEAEAELVAGSYDFLGLNYYVTQYAQPKPNPYPSETHTALMDAGVKLTDDNSRGEFLGPLDNGNSYYYPKGIYYVMDYFKTKYGDPLIYVTENLGFSTPTTENRGEAIADYKRIDYLCSHLCFLRKVIK

SEQ ID NO: 100 - protein, 460 aa, Brassica juncea
MKLLRRLALVFLLAAASCKADEEITCEENNPFTCSNTDILSSKNFGKDFIFGVASSAYQIEGGRGRGVNVWDGFSHRYPEKAGSDLKNGDTTCESYTRWQKDVDVMGEINATGYRFSFAWSRIIPEGKVSRGVNQGGLDYYHQLIDALLEKNITPFVTLFHWDLPQTLQDEYEGFLDRQIQDFKDYADLCFKEFGGKVKHWITINQLYTVPTRGYAVGTDAPGRCSPMVDTKHRCYGGNSSTEPYIVAHNQLLAHATVVDLYRTKYKFQNGKIGPVMITRWFLPYDESDPACIEAAERMNQFFHGWYMEPLTKGRYPDIMRQIVGSRLPNFTEEEAALVAGSYDFLGLNYYVTQYARPQPNPYPSETHTAMMDAGVKLTDDNSRGEILGPLVNGNSYYYPKGIYYVMDFFKTNYSNPLIYITENLGISSPSTESRCEAIADYKRIDYLCSHLCFLRKVIK

SEQ ID NO: 101 - protein, 458 aa, Brassica juncea
MKILHGLALVFLLAIASCKAYEEITCEQNEPFTCGNTDILSSKNFGEDFIFGVASSAYQIEGGRGRGVNVWDGFSHRYPEKSGSDLLNGDTSCESYTRWKKDVEIMGELNATGYRFSLAWSRIIPEGKVSRGVNQGGLDYYHQLIDALLEKNITPFVTLFHWDLPQTLQDEYEGFLDRQIQDFKDYADLCFKEFGGKVKHWITINQLFTVPTRGYALGTDAPGRCSPMIDERCYGGNSSTEPYIVAHNQLLAHAAVVDLYRTNYKDQQGKIGPVMITRWFLPYDESDPACVEAAERMNQFFHGWHMEPLTKGRYPDIMRQIVGSRLPNFTEEEAALVAGSYDFLGLNYYVTQYAQPQPNPYPSETHTAMMDAGVKLTDNNSRGEYLGPLIAGNSYYYPKGIYYVMDFFKTNYSNPLIYITENLGISSPGTENRCEAIADSKRIDYLCSHLCFLRKVIK

SEQ ID NO: 102 - protein, 458 aa, Brassica juncea
MKLHGLALIGFLIAAASCKAIEDINCQENEPFTCGNTDQLSSKIFPKDFIFGVASAAYQVEGGRGRGLNVWDGFTHRYPEKGGSDLGNGDTTCESYTRWQKDIDIMDELNATGYRFSFAWSRIIPEGKVSRGVNKGGLEYYHKLIDGLVAKNITPFVTLYHWDLPQTLQDEYEGFLNRTIDDFRDYADLCFKEFGGKVKNWITINQLYTVPTRGYAIGTDAPGRCSPKVDERCYGGNSSTEPYIVAHNQLLAHAAAVDVYRTKYKFQGGKIGPVMITRWFLPFDETDKASLYAADRMKEFFLGWFMEPLTKGRYPDIMRQIVGSRLPNFTEAEAELVAGSYDFLGLNYYTTQYAQPKPNPVTWENHTAMMDPGAKLTDTNSRGENLGPLINGDSYYYPKGIYYVMDYFKTKYRNPLIYITENLGFSTPGEETREEAIADSKRIDYLCSHLCFLRKVIR

SEQ ID NO: 103 - protein, 460 aa, Brassica juncea
MKLLHGLALVFLLAAASCKADEEITCEENNPFTCSNTDILSSKNFGKDFIFGVASSAYQIEGGRGRGVNVWDGFSHRYPEKAGSDLKNGDTTCESYTRWQKDVDVMGELNATGYRFSFAGARIIPEGKVSRGVNQGGLDYYHKLIDALLEKNITPFVTLFHWDLPQTLQDEYEGFLDRQIQDFKDYADLCFKEFGGKVKHWITINQLYTVPTRGYAIGTDAPGRCSPMVDTKHRCYGGNSSTEPYIVAHNQLLAHATVVDLYRTKYKFQKGKIGPVMITRWFLPYDESDPASIEAAERMNQFFHGWYMEPLTKGRYPDIMRQIVGSRLPNFTEEEAELVAGSYDFLGLNYYVTQYAQPKPNPYPSETHTAMMDAGVKLTDDNSRGEFLGPLVNGNSYYYPKGIYYVMDYFKTKYGDPLIYVTENLGFSTPSSENREQAIADYKRIDYLCSHLCFLRKVIK

SEQ ID NO: 104 - protein, 457 aa, Brassica juncea
MKHLWFALAFLLALAICKADEEITCEENLPFTCGQTDRFNSSSFEKDFIFGLASSAYQIEGSINRGLNVWDGFTHRFPDKAGPDHGNGDTTCNSYSYWEKDIEVMDELKATGYRFSIAWSRIIPGGKRSRGVHQGGINYYHGLINGLIEKGITPLVTLFHWDLPQVLQDDYEGFLDPQIDDFRDYADLCFEEFGDKVKHWFTINQLYSVPTRGYGLGSDAPGRCSPKVDPTCYAGNSSTEPYIVAHNQLLAHARVVDLYRTKYKHQGGKIGPVMITRWFLPYNDTDQDSIAATERMKEFFLGWFMGPLTNGTYPQIMIDTVGERLPSFTPEESKLVKGSYDFLGLNYYFSQYVQPSPNRVDWDRHIAMMDAGTKLTDRNASNHLIGPVETRNIYYYPKGIYYVMDYFKTKYNNPLIYITENLGILTSGDETREEAKFDYRRIDYLCSHLCFLSKVIK

SEQ ID NO: 105 - protein, 457 aa, Brassica juncea
MKHLWFALAFLLALAICKADEEITCEENLPFTCGQTDRFNSSSFEKDFIFGLASSAYQIEGSINRGLNVWDGFTHRFPDKAGPDHGNGDTTCNSYSYWEKDIEVMDELKATGYRFSIAWSRIIPGGKRSRGVHQGGINYYHGLINGLIEKGITPLVTLFHWDLPQVLQDDYEGFLDPQIDDFRDYADLCFEEFGDKVKHWFTINQLYSVPTRGYGLGSDAPGRCSPKVDSTCYAGNSSTEPYIVAHNQLLAHARVVDLYRTKYKHQGGKIGPVMITRWFLPYNDTDQDSIAATERMKEFFLGWFMGPLTNGTYPQIMIDTVGERLPSFTPEESKLVKGSYDFLGLNYYFSQYVQPSPNRVDWDRHIAMMDAGTKLTDRNASNHLIGPVETRNIYYYPKGIYYVMDYFKTKYNNPLIYITENLGILTSGDETREEAKFDYRRIDYLCSHLCFLSKVIK

SEQ ID NO: 106 - DNA, 23 bp, Artificial
  spacer
gtggaaaggtaaagcactggatc

SEQ ID NO: 107 - DNA, 23 bp, Artificial
  spacer
gtggaaaggtgaagaactggatc

SEQ ID NO: 108 - DNA, 23 bp, Artificial
  spacer
gtgacaaagtaaagcactggttc

SEQ ID NO: 109 - DNA, 23 bp, Artificial
  spacer
gtcctgtaaagatcgacgaccgt

SEQ ID NO: 110 - DNA, 23 bp, Artificial
  spacer
cgccgtaacacctgtgcttggta

SEQ ID NO: 111 - DNA, 23 bp, Artificial
  spacer
cgccgtaacatctctcatcaacc

SEQ ID NO: 112 - DNA, 23 bp, Artificial
  spacer
gagaacatcgaccaggtgcatct

SEQ ID NO: 113 - DNA, 2163 bp, Brassica juncea
atgacaatgatgatgatgagccttaccacatcgttaccgtacccttttcaaatcctactagtctttatcttgtccatagcatccatcactttgcttggccgaatactatcaagacccacaaaaaccaaagaccggtctcgtcagcttcctcctggaccaccaggatggcccatcctcggcaatttacccgaactaatgaagactcgtcctaggcacaaatatttcgaaattgccacgaaagggcaaaaaccggagatcgcgtgtttcaacttcgccggaacacacaccatcatcataaactcggatgagatcgctcgagaagcgtttaaagagcgagacgccgacttcgcagaccggccaaatactttcaacatgagaaccatcggaggcaatcacaaatcaatggggaacacacccaccggtgaacagttcatgaaaatgaaaagagtgatcacatcggagattatgtccgtgaaaacattaaacatgttggtagctgccagaaacattgaagcggacaacctccttgcttaccttctctcgatttataaacggtccgagacagccgacgttagagagatctcgaggaattatggttacgctgtgacaatgagaatgatgtttggaaggagacatgtcacgaaagaaaatgttttctccgacgagggaaggttaggaccagcggagaaagatcatcttgatgcgattttcgaaacgttaaactgtttgccgagtttctctccggctgattacttggaaaaatggtttctcggctggaacgttgatggtctagaggagagggtgacagtgaactgtaataaagtccgcagttacaacaatccgatcattgacgagagggtggagttatggagagagaaaggtggtaaggcagctgttgaagattggattgatacgttcattaccctaaaagatgaaaacggaaagtattatatcacgccggatgaagtcaaaggtcaatgcgttgtaagtgaacactagtagtattttactactataattgattatatatcataagacagttacaagatattattacaaaatattatgatcatcgacagtatagatatactactgatattattgaaaatggcattgcggatagttttacatgttttttgtttcaaaagaaatatatcaacaaaaaattaatatttagattttttttgttatatgaagaatcaacttttattaattgttttaggaccccgttaaatatattgtttggtgttttatttcaggaattttgcatagcagcgatcgataatccggcaaataacatggaatggacacttgcggaaatgttaaagaacccggagattctcaaaaaagctttgaaggagttagacaaagtggtgggaagagacaggcttgttcaggaatctgacataccaaacctaaactacttaaaagcttgttgcagagaaacattcagggttcacccaagtgctcattatgtccctactcatgtggctcgtcgagatagcaccctcggaggttatttcattcccaaaggtaaaacaacaaaaattgtgtagtaactcaagactttacatttttacaatagcaaagcttatgcatagttagattgtaacaatatttgcgacgattaaaattctaccaaacgtattcaaaatttggatcatgcatctaaccatatacaaagtaatcttgttgattttgtttagattcatgactggtttttgatgatgcgtgcaaatactccaccagtagttttgtatgatgcgtgtattaaaaaagtatttgttttggacaggtagccacattcacgtcgcccgtcctggaataggccggagctccaaagtatggaaagatccattggtatacaaaccggagcgtcacctcgaaggaaatggaatctcgaaggagctttctctggtcgaaaatgaaatgcgtttggtgtcgtttggtaccggtcggcgtggctgcatcggtgtgaaagtcgggacgatcatgatggttataatgttggctaggtttcttcaagcgtttaactggaaactccatcctagttatggaccgttaagtctagaggaagatgatgcattgcttatggctaagcctcttctcttgtccgttgagccacgcttggcacccaacctttacccaaaattctacccttga

SEQ ID NO: 114 - DNA, 1626 bp, Brassica juncea
atgacaatgatgatgatgagccttaccacatcgttaccgtacccttttcaaatcctactagtctttatcttgtccatagcatccatcactttgcttggccgaatactatcaagacccacaaaaaccaaagaccggtctcgtcagcttcctcctggaccaccaggatggcccatcctcggcaatttacccgaactaatgaagactcgtcctaggcacaaatatttcgaaattgccacgaaagggcaaaaaccggagatcgcgtgtttcaacttcgccggaacacacaccatcatcataaactcggatgagatcgctcgagaagcgtttaaagagcgagacgccgacttcgcagaccggccaaatactttcaacatgagaaccatcggaggcaatcacaaatcaatggggaacacacccaccggtgaacagttcatgaaaatgaaaagagtgatcacatcggagattatgtccgtgaaaacattaaacatgttggtagctgccagaaacattgaagcggacaacctccttgcttaccttctctcgatttataaacggtccgagacagccgacgttagagagatctcgaggaattatggttacgctgtgacaatgagaatgatgtttggaaggagacatgtcacgaaagaaaatgttttctccgacgagggaaggttaggaccagcggagaaagatcatcttgatgcgattttcgaaacgttaaactgtttgccgagtttctctccggctgattacttggaaaaatggtttctcggctggaacgttgatggtctagaggagagggtgacagtgaactgtaataaagtccgcagttacaacaatccgatcattgacgagagggtggagttatggagagagaaaggtggtaaggcagctgttgaagattggattgatacgttcattaccctaaaagatgaaaacggaaagtattatatcacgccggatgaagtcaaaggtcaatgcgttgaattttgcatagcagcgatcgataatccggcaaataacatggaatggacacttgcggaaatgttaaagaacccggagattctcaaaaaagctttgaaggagttagacaaagtggtgggaagagacaggcttgttcaggaatctgacataccaaacctaaactacttaaaagcttgttgcagagaaacattcagggttcacccaagtgctcattatgtccctactcatgtggctcgtcgagatagcaccctcggaggttatttcattcccaaaggtagccacattcacgtcgcccgtcctggaataggccggagctccaaagtatggaaagatccattggtatacaaaccggagcgtcacctcgaaggaaatggaatctcgaaggagctttctctggtcgaaaatgaaatgcgtttggtgtcgtttggtaccggtcggcgtggctgcatcggtgtgaaagtcgggacgatcatgatggttataatgttggctaggtttcttcaagcgtttaactggaaactccatcctagttatggaccgttaagtctagaggaagatgatgcattgcttatggctaagcctcttctcttgtccgttgagccacgcttggcacccaacctttacccaaaattctacccttga

SEQ ID NO: 115 - protein, 541 aa, Brassica juncea
MTMMMMSLTTSLPYPFQILLVFILSIASITLLGRILSRPTKTKDRSRQLPPGPPGWPILGNLPELMKTRPRHKYFEIATKGQKPEIACFNFAGTHTIIINSDEIAREAFKERDADFADRPNTFNMRTIGGNHKSMGNTPTGEQFMKMKRVITSEIMSVKTLNMLVAARNIEADNLLAYLLSIYKRSETADVREISRNYGYAVTMRMMFGRRHVTKENVFSDEGRLGPAEKDHLDAIFETLNCLPSFSPADYLEKWFLGWNVDGLEERVTVNCNKVRSYNNPIIDERVELWREKGGKAAVEDWIDTFITLKDENGKYYITPDEVKGQCVEFCIAAIDNPANNMEWTLAEMLKNPEILKKALKELDKVVGRDRLVQESDIPNLNYLKACCRETFRVHPSAHYVPTHVARRDSTLGGYFIPKGSHIHVARPGIGRSSKVWKDPLVYKPERHLEGNGISKELSLVENEMRLVSFGTGRRGCIGVKVGTIMMVIMLARFLQAFNWKLHPSYGPLSLEEDDALLMAKPLLLSVEPRLAPNLYPKFYP

SEQ ID NO: 116 - DNA, 23 bp, Artificial
  spacer
aaaagggtacggtaacgatgtgg

SEQ ID NO: 117 - DNA, 23 bp, Artificial
  spacer
aaatcctactagtctttatcttg

SEQ ID NO: 118 - DNA, 2558 bp, Brassica juncea
atgggttcagacagtactccccaacttccagtgatctatctctcggaccaaaccctaaaaccaggaagtgagaagtgggttgaagtgaggaatgatgtccgtaaagctcttgaagactacggagctttcgaggtgtcatatgatagagtgtcagaggagctaaagcaatcggttttggaagccatgaaagagcttttcgagttaccagttgaggctaaacggaggaacgtgtctccaaaaccctacactggatactcgactcataatggtctttccgagagtttggggatccaggatgccgaggttttggagaaagttaacgaatttactcaactgctacgccctgattttgagggtaacaagagtatcaggtaaggttatgttatgtgaacagcacgatattgctcaatgtgcaagaaatcgctaagcggtaattatgtgatttaaatgagattagtgcataggcaacataccatctagacagatatttttaacaatcaacagagaaaatcgtttcatagtgtatgtctgatactctgatttgtgcataaactgcgtaggccaattttaaaacacaaggattgcttcacaaagtaacttgttcgtaaaccctgttgatttctttatcaaatatattgttcgtaagtttttgttaattgcttctatataaaacaagaatatttgtttcttacataatacgttcacgcgttttgtttttgttttgttcttctcttttttattaaaatgtttaaagaaatttctttttgttgaaaacagcgaaacaatccagaagttttcagagaagctagcagaattggatgtaatggtgagaagaatggttatggagagctttgggatagagaagtactttgatgaacacctcaagtcaacgaattaccgtctgcgactgatgaagtatatagcacctcctgatgttgatactaatgttgcagcgggtgctaatgatgctggtgatggttctaatgatgctggtgctagtgataatgccaatgttgttgctgatactagtgatattgctagtggtattgctaatgttcatattaatgatgacgccaatattggtgctacggctaatggcgacattggtgctgatgttgatgctaaaactagtgattttgctagtgttgagtctaaagccgacgttagtaccaatgttaatgctaatgctgatgccaatgctaatactggtactctcagtagtgctggtgttggtgatagtgttacagctaatggtggtgctgatgatgaggagaagaaattgggtttaccttctcatactgataaaaatcttttcactgtgctttatcaatatgagattgaaggtttggaggtgttaaccaaagatgaaaagtggatcagactgaaaccatctcataactctttcgttgttatggctggagattctgtatatgtaagttaacttcttctttctttttatgagatgacatgcacatgtaaaatattaaccgctcctcattatattcatgattttatagcataaatatttcataatttacttttatattcttttcctttgaatgaaaactaagaacttttacttttatattcaaaaacctaaacccaaacgaatttttttttactgtttcatagtattatttcaaactatgaaaattcagagactatatatatatatatatatatatatatatatatatatatatatatatatatatactgatatgtgatagttacaaaagtaaatccaccttataacttttgatgtttttttattgagtatttgcttcgtaaacgttgatgatctgtgatctctttttcctttttggtaagtatgatttgtgatctcttcaaaagttttaaggtttttgatatggttgtgcatgattacataggctatctaccagaactaaattgagacagaaaacgtgttggaataatagaaagtaacccatcttttaaaattagaagtcgaggaagaaaaaactaaaagaaaaaaaaaactagcggagaaaaaggttcaattcactttccactaaggtgaccaaccaattcctctctctacaaacaaatgtcttatgattctatttgctcttgttcactctcactagtcacgagtgttaggggaccaaccaaatcttatagcaactgatgttttatttgctcttatcacttttcactacaagcgcatgtcttggcttacatcatatgttttttttcttctgatcatgaccttgctcttgacaaaaataaaagtaacagtgatttacttggtgatgtttttgtctttttgtttgcaggcacttatgaatggtagactatttcgtccttttcatcgagtgagagtaacagagaaaaagaagacaagatattcaatagcattgttctcgactccaaacgcaggctacatcatagaaccaccaaaagaacttgtggacgaaaagcatccacgagtcttcaaaccattcacttatgttgacttgatgagtttctatcacactgagggtggtcgtagagctcgttctactcttcatgcttattgcgccgtctctgaagcatga

SEQ ID NO: 119 - DNA, 5632 bp, Brassica juncea
ggatatgcaccaaaggaaagaagaatgggttcagacagtactcctcaacttccagtcatccatctctcggaccaaaccctaaaaccaggaagtgagaagtgggttgaagtgaggagtgatgtccgtaaagctcttgaagactacggcgcgttcgaggtgtcatatgatagagtgtcagaggagcttaaggaatcggttttggaagccatgaaagagcttttccagctacctgttgaggccaaaagaagaaacgtgtctcccaaaccctacactggatatatgactcataatggtatttccgagagtctggggatccaggatgccaatgttttggagaaagttaacgaatttactcaactgctacgccctgattgtgagggtaacaagagtaccaggtccgtattgttatgaacttcatagagtaaaagggaaaattaatctcttagataacaaaaaaaaaaattgtaacaaaaaaacacccaattagaaccttaaactagcactaattaagagataaaataactaaattactccaaaccctaaacccttactctaatcacattttctaaatattaaaccttaaactataatcactaaactctaaactgtaaattctaatcactaaacccaaacacaaatataaaataaaaagaactaaaacttttaattaatgatattttgaaaaaaatttcccttactattttctatcaaaaagattagggctgttcaatatggtaaaaccgaaccgtaccgaaccgaaccgaaccgaaatagacaatatggtttggttttggtatatactatataaaccgaatggatataattttataaaaaycgtaggatttggatatggtttggtatataactgattaaaccgaataaaccgaacaaaaccgattaaaagtagaaacatgtaaatatgtatctattttataacaatacatgaaaatctatttgttacataagttaaatttgtgttaataactattaccataattttatagtaataaaaaaccttaatttgtaaaacacttgaaatataactaaataaccatacatcgcaattcagacatcttattttctaagtttttcttgatatttttgctttattttagtctttactaaattaatatgaagattataaatttgagggacaataattaatggaaaattttcaattgaaaaagcatgactttaatgaacactaaatatagaagagtgaaaaaacttttctttcatgtttctattttgtttcatatttttattttcaaaatttcaaattttgattttagttatagattttattattttatttgatggtagaagcatttttacttttttgttcatttatttgaacatgtaatatatttttaataaaggattgtgttaagaatatgactctaaaattcatataatctagattttgacccgcgcaggcgcgcgggtgtatattttgaaaaatatgtgatatttgtttttcatgtaattattaggattggaaaaatgaatccgaggaacataaccgataccgatccaaagatatagtaccaaacccaaacataaattgattaaatattctaattattcaaaattttgttatttagagaaccgaatctgatccgaaccgaagtatttgggtatccgaatttatctaaaaatagatttatatacttatatatattaatatttttagatttaacgtatataaaacatcaaaaatgatacttttaaattggtttaaatacttgaaaatatatatagatagtcaaaagtaaatatctgaaatagttaaagtatactcaaatcaccaaaaatacttaaaataattattgatttcgtatccaaaattttaaatcaagccaattgatatgttaagcttaagtattatgacatatgttattcaaatttatacgtaatatattattttatttataacatttgagaaatttaaaatatataatgatttaagactttaaaaataatttaaattagttatccaaacccaaaccaaacccgcaaagatccaaatcgaactcaaaccaaaatttagaaacattctaataaggctgaaatctttgaccccgaaaactcaaaatacaaaccgatcagaactaaacccgtatgggtatcaaaagcccatccctagtcattattatatatcgtattttatcatcatataattaatcgtattttatatgtaccatcatataagtaatcatataattaatagtattttatacataccatcatataaataattacatatattatatttttaaaacttaatatgaaatatgaaaaccataatttgagttggtatttcaaattgggctttgtattatatttttcttatatatattgacaatatttttttataatggttattgaaaaatagtttagtaaaaatccatttttgaatatatgtatatttttgaatcaatttttgatataaatcaaatttgaattattattttgatttgaaatatgtatataaagtttaaattttgttttatggttagtttagaaaaaaaaattttagggaattagattgacccattttggtatattttaaaagtggcctagataactttcaattttttaaaaaaacataagcccattacttttttttcttaatactactatccttgttttcaaacaaaaatattttttttaaaagactgcaatccatgtttccaaacactccaaatttttaaaagtcctattcaagtctccaaacactccaattttgtacttgagttttaataagatagatgatctcaaacaaaataattatgttttttggtataaaaccgaataaaccgaaaaccgacggtatataaaccgaaccgaaccgaagtaaatatggatttagaatggtaatcatattttactaaccgaaataccgaaaaccgaaaaaaaccgaaccgaaaccgaaccgatatccggattgaacacccctaaaaaagatgttttagtgatatctttgggtatttctggaaagtaaattgtacgtaaattcttgttagtattatcgaatatattgttcctaggatttcgttaatttcttctagttagagcatgttatatatttttccgctcaaaatagtattatttgtgtagttcagacaagtgacaatttttttttctgtctacatagaaaacttgatttttatatattgttccgtagagaaaatgctagttcactcagatatgaaaccaatgacttaaattttttaatttcatagtatacgttcttgcgtttttgttttgttgttttcttctcttgtatctattcaaattgctcaaagaaatttctgtcttgaaaacagcgaaaggatacataagttttcagagaagatggcagaattggatgtaatggtgagaagaatggtatttgagagctttgggatagaggattactttgatgagaacctcaagtcaatgaattaccgtctacgactgatgaagtattcagcaccacgtgatgttgatacgaatgttgcggcaggtgctaatgatgctggtgatgctgctaatacgaataacaatggtaatactggtgcggatgttggtgctggcgattcagccagtactggtgacaatgacaaggttgttgctagtgatgatgctaatgctggtgctgatactaatgatattgttgttggtattgctaacgttcatattgatgatgatgctaatgatgttgctaaagctaatggcgacgttggtgctggtgttgatgctaatactaatgattgtgctagtgttaagtctagcgccgacgttgataatgttaatgctaatgtcagtgttggtactaatggtgatactaatgctaatgttggcgctgatattgaggagaagaaattaggcttaccttctcatactgataaaaaccttttgacagtactttatcaatatgagattgaaggtttggaggtgttaaccaaagatgaaaagtggatcagagtgaagccatctcataacactttcgttgttatcgctggagattctctacatgtaagttaactcctttttaaatggcatgcatgcataaaatattaactcctcatattaatcaagattttatgacatacttatggaataatttaccctttaatattctaaattaatcaagccaaatcttttttactgtttcgtagtattatttgaaaactattgaaattcagagcctatacatacagatattaattgatatgtacatagttacaaaagtaaatacaccttatcgattttgatgttatttgctttctaaacattgatgattgccgacaaaaaaaaacattgatgatttgtgatctgtccaaaagttttaaggttttgctataattgtgcacgaattgatcatctagccttcaaaaaaaaaacatagattatctaaactaactgaattacagatagagaaattaaagtattatagtaatggaatgtaactaaattagtggaagaaaaaaaagaaaaatattatttaattcacgttcactctttctctacgaactaatattttatgatttcatacttttatgtgctcatgtttactctctcattcacaggggccaggagaccaaccaaacatataacaatattaaaactataaacgtatctctattttttcttataatataattttgtaaatagaaacaaatttttactctaatatatttttctataataaaaaaatattatattttcatactttagaaatactgttttcatctctatatttaaaaataataaatagcatttccttattgtagagaaaatatagcatctatatactaaagatgaacgcatttgagtaaaaattcattgttatttttaaaaaattatattataaatttttttttaaaaacattaacatcaaaattttctcagaatttatcaacattaaaatagccaaaagaataaaaatagaaaaaaagaatgtgggaaagaaagaaaaaatgtaagaaaaaaaactttctttgaaaaaactatgagagacacaaatcacatgtgtcagtatgtaagtattcatatttattctatgtttaaaatttaattatataataaaattatactgctgacaaaaaaagtatactaatattaaaaattgagatatacaccttaaaaattataccaatgatgatcgctctaatgtcttatgatttatttgctcttgtcactttcactttcagtccagttagacaattagtgcatgtctatacaccatgttttgcttactttctatttgacgaagttaattatttcatttttaatgtttattttcttctgatcatgatcttggtgttacacaaaaataagtactaatgatgtacttggcgatgtatatgttttttgattgcaggcacttatgaatggtagactatttctcccgtttcatcgagtaagagtgacggagaaaaagaagacaagatattcaataggattgttctcgactccaaatagagattacatcatagaaccaccaaaggaacttgtggacgagcagcatccacgtgtattcaaaccattaacttacgttgacttaatgagcttctatcacactgaggttggccgtagagctcgatctactctgcatgcctattgtgccgtctccggagcttaaatg

SEQ ID NO: 120 - DNA, 1781 bp, Brassica juncea
atgggtgcagacactcctcaacttccagtcatctatctctcggaccaaaccctaaaaccaggaagtgagaagtgggttgaagtgaggagtgatgtccgtaaagctcttgaagactacggcggttttgaggtgtcatatgatagagtgtcagaggagctgaagaagtcagttttggatgccatgatagagcttttcgagttaccagttgaggctaaacagagaaacgtgtctccgaaaccgtacactggatattcaactcataatggtctctctgagagtctagggatccaggattccaatgttttggagaaagttaacgaatttactcaactgctacgccctgattgtgagggtaacaagactatgaggtaacgtcatgtcaaaaaaaaaaaactaagtaatgcttcgtagagtatattgttcgtaaactcctgttattttttcatcaaaaatattttcgtaatttttttgttagttgcttttataagctatgtaacaattttctatataaaaccttgtttttatttttattttttttggaaaaatgtcagttcacttatatagtaatgaactgaaaatttgttttcaatctcacgtttctcgcattttattttcttgtttctattaaaatagctatataattttctttgtgttgaaaacagcgaaacgatccagaatttttcagagaagttagcagaattggatgtaatggtgagaagaatggtcatagagagctttgggatagaaaactactttgatgaacacctcaagtcaacgaattaccgtttgcgactgatgaaatatgtagcaccacctgatgttgatgctaatgttgcggttggtactaaagattctgatgatggtgctaatacgaatacaactgctaacgctgatgctgatgatattgctaatggtattgctaaagttcatattgatgacgatgctgatgccaagggtgacgtttgcactggtgctggtaccaatcataatggtgatgacgttaatactggtgattgtgctaatgttaagtctaatgtcgacgttggtactaatgttagtgctaaatctagtgttggtgctgatgttaacactggcactattgatgatgttaatgctaatgctggtactcgtagtagtgctaatgttggcgttagtgatagtgttaaagctaatggtggcgcagatgatgaggagaagaaattaggtctaccttctcatactgataaaaaccttttgacggtactttatcaatatgagattgaaggtttggaggtgttaaccaaagatgaaaagtggatcaggttaaaaccatctcataactctttcgttgttatggctggagattctctatatgtaagttctaacttattttatttttaaatgggatgcacctttttattttttcctatcactttcacaaatgcatgtcttttctttactaaagtgtttatacattaacattatatgttttcttctcatcatgaaacttgttttgatttttgtattatttttgtttgcaggcacttatgaatggtagactgtctcgtccgtttcatagagtaagagtaacggaaagaaagaagacaaggtattcaatagcattgttctcgactccaaacggagattacatcatcgaaccaccaaaagagcttgtggacgagaagcacccacgtctcttcaaaccattcacttacgttgacttgatgagtttctatcacactgaggctggtcgtagagctcgttctactcttcacgcttattgtgccgtctctggagcataa

SEQ ID NO: 121 - DNA, 4049 bp, Brassica juncea
atgggttcagacagtactcctcaacttccagtgatctatctctcggaccaaaccctaaaaccaggaagtgagaagtgggttgaagtgaggagtgatgtccgtaaagctcttgaagactacggcgctttcgaggtgtcatatgatagagtgtcagaggagcttaaggaatcggttttggaagccatgaaagagcttttcgacttaccagttgaggctaagcagagaaacgtgtctccaaaaccctacactggatattctactcataatggtctctccgagagtctagggatccaggatgctgaggttttggagaaagttaacgagtttactcaactgctacgtcctgattgtgagggtaacaagagtatcaggtaaggttatgttatgtgaaaagaacaatattgcttatgatgtgcaggaaatcgttaagcggtaattaagcgatgtaaatggaactagttcctaggcgtcatatagaccaatatttttaacaatcgatatagaaaatcattcgtagtctatggctgattttccgtatagactacctagaccgagttttacaacacaactagattttgacccgcaaatccttgtggatattttcattttataaatgtataattttgatatatcctaagttttctagttttttttgtcatcaaaatgttgtaaatatatgatttatattttaatattatatattttgtaactctataatcttattggttaagttttttattcgacattattcatatataatgatttgctttatacattttacatttgttatataattttattatttttcaatcgttcataaataaattcataatttgaaataatcaaatagagaatctccttcaattttatatattgcatgcataatatcattttaaaattttatttagttatactatagaaatgatatattgtttaggataatttatattatcatattgtgtttaaaaaatatactttaacatatattattttagtatttactgcagatttataagtaaatacattgtttaatttaaagtaattaacacgtattattttaataaattttatacatagagccatctatcatacttatcttgtaattttattcgtatatgatatattttggatgtttatgatattaattttttgattaattaaattaagacttcaaaatattagattactttaatttttataacatagtttgttttttcgtgttacatttcaaaaagttattctttattatctatgattataccttcagaaaaatttaaaacattatcattttaagtttgcatacttattttttaaattttatattttgtcaaattgtttggaaaattacacaactatatttgaggtgggagattatatgatttttgaaatttgtttgttgctaaattaatacattatttttatataaataatattaatttggtaagattattttcttaaatattttttataatttaatgtaaaattaaaatttctatttaaatttgatttttcgttaaattttagaatgaattattaaaatttcatagttttctaataacatatttttaaatagttatgactaaagttattatttattatattgataaacattataaaaatatattgttgggagtttcaaaataaataaaaggatatatatgttgagatataaaattttaacactatgttaataaatttatttttgtataaaatattattagttagatgttaaccattttaatgataatgataatttattaaatgaaataatttaataaaaacttaattactatgaatataattgtcatatttaattcactatctcaattcatttttatataatacataatataatatagaatactataaaataatcgtataaatttatattttcttttgttttatgaataaaattttattaacattagatttgtaactaatattttattactaattacgaaattaattaatatgttattttataaaaatatttaaatttagtaagattttgttacattctttttcaagatattttaaaattcaattttatagttggtttattattaatgtaaataatcaaatatgtcacattacctaatttataaatggtcctactatgatttgtttatgatagataaaatataggaccctaaattaatagattagattattgcttcacaatgtaacctgttcgtaaatcttgttgatttctttaccaaatatattgttcgtaagtttttgctaattgcttctatttaaagcaataatttttgtttcttatagtatgttctcacgttttgtttttgtcttttttctcttttttaaaagtgtttaaagcaatttctttgtgttgaaaacagcgaaacaatccagaagttttcagagaagttagcagaattggatgtaatggtgagaagaatggttatggagagctttgggatagagaagtactttgatgaacacctcaagtcaacaaattaccgtctgcgactgatgaagtatatagcaccacctgaagttgatactaatgttgcggtgggtgctaatgatgctggtgatggtgctaatgatgcaagtgctagtgataaggccaatgttgttgctggggatgaagataatgttggtgctgatactagtgatattgctaatggtatagctaatgttcatattgatgatgacgctaaggctaatggcgacattggtgctgatgttgatgctaaaactagtgattgtgctaatgttgagtctaaagccgatgttagtaccgatgttaatgccaattctgattccaatgctaatactggtactcttagtagtgctagtgttggtgatattgttaaagctaatggtggtgctgatgatgaggagaagaaattaggtttaccttctcatactgataaaaatcttttcacggtgctttatcaatatgagattgaaggtttggaggtgttaaccaaagatgaaaagtggataagattgaaaccatctcataactctttcgttgttatggctggagattccgcatatgtaagttaacttcttctcctttttttaagacgacatgcagacgtaaaatattaacattcaccattgcattcatgattctatgtcccataatttacttttatattatttttaatgaaaaataagaatttttacttttatattataaaaaaaatcaaactaaattgtttttactgtttcattatattatttgaaactattaaaattcagagcctatatatatatatatatataacatttgatgtaattttctttctacacgttgatgatttgagatctctccaaaagttttaatgtttgatatggttatgcatgattacatagtctatctactagaactaaattgagacagagaaagtgttggaataatagaaagtaatccatcttttaaaattagaagtcgaggaagaaaaaacttttttaaaaaactagtggagaaaagaaaaagatgatttcaattcacttttactaaggtgaccaaccaaatttgctctcgacaaactaatttcttatgattctaattcctcttgttcactctcactagtcactagggttagggaccaaccaaatcttatagcaactaatgtttttttttgctcttatcgctttcgctagcaagcgtatatgtcttggcaatacaccatgtgtttcttttctcctgatcatgacctttctcttaacaaaggataaagtaacaattttaccaaaaaaaaggataaagtaacgatgatgtacctggtgattttttgtcattttgtttgcaggcacttatgaatggtagactttttcgtccgtttcatcgagtaagagtaacggagaaaaagaagacaagatattcaatagcattattctcaactccaaacgcaggtaacatcatagaaccaccaaaagaacttgtggacgagaagcatccacgagtcttcaaaccattcacttatgttgacttgatgagtttctatcacactgaggctggtcgtagagctcgatctactcttcatgcttattgtgccgtctccgaagcatga

SEQ ID NO: 122 - DNA, 1808 bp, Brassica juncea
atgggtgcagacactcctcaacttccagtcatctatctctcggaccaaaccctgaaaccaggaagtgagaagtgggctgaagtcaggagtggtgtccgtaaagctctcgaagaatatggtgctttcgaggtgtcatatgatagagtgacagaggagcttaagaagtcagttttggatgccatgatagagcttttcgagttaccagttgaggctaaacagagaaacgtgtctccgaaaccctacatgggatattcgactcataatggtctctctgagagtctagggatccaggatcccaatgttttggagaaagttaacgaatttactcaactgctacgccctgattgtgagggtaacaagagtatgaggtaactgtcatgtcaagaaaaactcaataatgctccgtataataaattgttcgtaaactattgttaattttagtcaaatgtatttttgtaatttttttagttgcttttataagttatgcgacaattttctatatgaaaccttgttttatttatttttttgtgtggaaaacatgtcaggttcactcatatagcaatgaactgatattttgtttcaatcacacgtttctcgcattttattttcttgtttctataaaatagctatactaattttctttctattgaaaacagcgaaacaatccagaagttttcagagaagttagtagaattggatgtaactgtgaaaagaatggtcatacagagctttgggatagagaactactttgatgaacacctcaagtcattgaagaattaccgtatgcgactgatgaagtacgtagcaccacctgatgttgatgctaaagatgctgatgatggtgccaatacgaatctgaatgctaacgctgatgcggatgctggtgctggtgatattgctaatggtattgctaatgttcatattgatgaagatgttaatgccaagggtgacgttggcactggtggtggtgatgctaatcataatggtgatgatgctaatactggtgattctgctagtgtaaagtcgaatgttgacgttggtactgatgttaatgttaaagctagtgttggtgctgatgttaacgttggcactattgctgatgctaatgctaatattggtactcttagtagtgctaatgttggcgttggggatagtgttaaagctaatggtggcgctgatgatgaggagaagaaattaggtttaccttctcatactgataaaaacctcttgacggtactttatcaatatgagattgatggtttggaggtgttgaccaaagatgaaaagtggatcaggttgaaaccagctcacaactctttcgttgttatagctggagattctctatatgtaagttttaacttattttttatttttaaatgacatgcaccgtaatatattaattgcgatcctataataatcaagactttttatttgctcttataactaattcacaagtgcatgtttttactaaagcgttatatacatcattttatgttttcttctgatcataaatcttgtgttgatgtttttattatttttgtgtgcaggcacttatgaatggtagactatctcgcccgtttcatagagtaagggtaacagaaagaaagaagacaaggtattcaatagcattgttctcggctccagacggagattacatcatcgaaccaccaaaagagcttgtggacgagaagcacccacgtctcttcaaaccattcacatatgctgacttgatgagtttctatcacactgaagctggtcgtagatctcgttctactcttgacgcttattctgctgtctctggagcataa

SEQ ID NO: 123 - DNA, 1287 bp, Brassica juncea
atgggttcagacagtactccccaacttccagtgatctatctctcggaccaaaccctaaaaccaggaagtgagaagtgggttgaagtgaggaatgatgtccgtaaagctcttgaagactacggagctttcgaggtgtcatatgatagagtgtcagaggagctaaagcaatcggttttggaagccatgaaagagcttttcgagttaccagttgaggctaaacggaggaacgtgtctccaaaaccctacactggatactcgactcataatggtctttccgagagtttggggatccaggatgccgaggttttggagaaagttaacgaatttactcaactgctacgccctgattttgagggtaacaagagtatcagcgaaacaatccagaagttttcagagaagctagcagaattggatgtaatggtgagaagaatggttatggagagctttgggatagagaagtactttgatgaacacctcaagtcaacgaattaccgtctgcgactgatgaagtatatagcacctcctgatgttgatactaatgttgcagcgggtgctaatgatgctggtgatggttctaatgatgctggtgctagtgataatgccaatgttgttgctgatactagtgatattgctagtggtattgctaatgttcatattaatgatgacgccaatattggtgctacggctaatggcgacattggtgctgatgttgatgctaaaactagtgattttgctagtgttgagtctaaagccgacgttagtaccaatgttaatgctaatgctgatgccaatgctaatactggtactctcagtagtgctggtgttggtgatagtgttacagctaatggtggtgctgatgatgaggagaagaaattgggtttaccttctcatactgataaaaatcttttcactgtgctttatcaatatgagattgaaggtttggaggtgttaaccaaagatgaaaagtggatcagactgaaaccatctcataactctttcgttgttatggctggagattctgtatatgcacttatgaatggtagactatttcgtccttttcatcgagtgagagtaacagagaaaaagaagacaagatattcaatagcattgttctcgactccaaacgcaggctacatcatagaaccaccaaaagaacttgtggacgaaaagcatccacgagtcttcaaaccattcacttatgttgacttgatgagtttctatcacactgagggtggtcgtagagctcgttctactcttcatgcttattgcgccgtctctgaagcatga

SEQ ID NO: 124 - DNA, 1308 bp, Brassica juncea
atggcagaattggatgtaatggtgagaagaatggtatttgagagctttgggatagaggattactttgatgagaacctcaagtcaatgaattaccgtctacgactgatgaagtattcagcaccacgtgatgttgatacgaatgttgcggcaggtgctaatgatgctggtgatgctgctaatacgaataacaatggtaatactggtgcggatgttggtgctggcgattcagccagtactggtgacaatgacaaggttgttgctagtgatgatgctaatgctggtgctgatactaatgatattgttgttggtattgctaacgttcatattgatgatgatgctaatgatgttgctaaagctaatggcgacgttggtgctggtgttgatgctaatactaatgattgtgctagtgttaagtctagcgccgacgttgataatgttaatgctaatgtcagtgttggtactaatggtgatactaatgctaatgttggcgctgatattgaggagaagaaattaggcttaccttctcatactgataaaaaccttttgacagtactttatcaatatgagattgaaggtttggaggtgttaaccaaagatgaaaagtggatcagagtgaagccatctcataacactttcgttgttatcgctggagattctctacatgcacttatgaatggtagactatttctcccgtttcatcgagtaagagtgacggagaaaaagaagacaagatattcaataggattgttctcgactccaaatagagattacatcatagaaccaccaaaggaacttgtggacgagcagcatccacgtgtattcaaaccattaacttacgttgacttaatgagcttctatcacactgaggttggccgtagagctcgatctactctgcatgcctattgtgccgtctccggagcttaaatgggttcagacagtactcctcaacttccagtcatccatctctcggaccaaaccctaaaaccaggaagtgagaagtgggttgaagtgaggagtgatgtccgtaaagctcttgaagactacggcgcgttcgaggtgtcatatgatagagtgtcagaggagcttaaggaatcggttttggaagccatgaaagagcttttccagctacctgttgaggccaaaagaagaaacgtgtctcccaaaccctacactggatatatgactcataatggtatttccgagagtctggggatccaggatgccaatgttttggagaaagttaacgaatttactcaactgctacgccctgattgtgagggtaacaagagtaccaggtccgtattgtta

SEQ ID NO: 125 - DNA, 1320 bp, Brassica juncea
atgggtgcagacactcctcaacttccagtcatctatctctcggaccaaaccctaaaaccaggaagtgagaagtgggttgaagtgaggagtgatgtccgtaaagctcttgaagactacggcggttttgaggtgtcatatgatagagtgtcagaggagctgaagaagtcagttttggatgccatgatagagcttttcgagttaccagttgaggctaaacagagaaacgtgtctccgaaaccgtacactggatattcaactcataatggtctctctgagagtctagggatccaggattccaatgttttggagaaagttaacgaatttactcaactgctacgccctgattgtgagggtaacaagactatgagcgaaacgatccagaatttttcagagaagttagcagaattggatgtaatggtgagaagaatggtcatagagagctttgggatagaaaactactttgatgaacacctcaagtcaacgaattaccgtttgcgactgatgaaatatgtagcaccacctgatgttgatgctaatgttgcggttggtactaaagattctgatgatggtgctaatacgaatacaactgctaacgctgatgctgatgatattgctaatggtattgctaaagttcatattgatgacgatgctgatgccaagggtgacgtttgcactggtgctggtaccaatcataatggtgatgacgttaatactggtgattgtgctaatgttaagtctaatgtcgacgttggtactaatgttagtgctaaatctagtgttggtgctgatgttaacactggcactattgatgatgttaatgctaatgctggtactcgtagtagtgctaatgttggcgttagtgatagtgttaaagctaatggtggcgcagatgatgaggagaagaaattaggtctaccttctcatactgataaaaaccttttgacggtactttatcaatatgagattgaaggtttggaggtgttaaccaaagatgaaaagtggatcaggttaaaaccatctcataactctttcgttgttatggctggagattctctatatgcacttatgaatggtagactgtctcgtccgtttcatagagtaagagtaacggaaagaaagaagacaaggtattcaatagcattgttctcgactccaaacggagattacatcatcgaaccaccaaaagagcttgtggacgagaagcacccacgtctcttcaaaccattcacttacgttgacttgatgagtttctatcacactgaggctggtcgtagagctcgttctactcttcacgcttattgtgccgtctctggagcataa

SEQ ID NO: 126 - DNA, 1299 bp, Brassica juncea
atgggttcagacagtactcctcaacttccagtgatctatctctcggaccaaaccctaaaaccaggaagtgagaagtgggttgaagtgaggagtgatgtccgtaaagctcttgaagactacggcgctttcgaggtgtcatatgatagagtgtcagaggagcttaaggaatcggttttggaagccatgaaagagcttttcgacttaccagttgaggctaagcagagaaacgtgtctccaaaaccctacactggatattctactcataatggtctctccgagagtctagggatccaggatgctgaggttttggagaaagttaacgagtttactcaactgctacgtcctgattgtgagggtaacaagagtatcagggaaacaatccagaagttttcagagaagttagcagaattggatgtaatggtgagaagaatggttatggagagctttgggatagagaagtactttgatgaacacctcaagtcaacaaattaccgtctgcgactgatgaagtatatagcaccacctgaagttgatactaatgttgcggtgggtgctaatgatgctggtgatggtgctaatgatgcaagtgctagtgataaggccaatgttgttgctggggatgaagataatgttggtgctgatactagtgatattgctaatggtatagctaatgttcatattgatgatgacgctaaggctaatggcgacattggtgctgatgttgatgctaaaactagtgattgtgctaatgttgagtctaaagccgatgttagtaccgatgttaatgccaattctgattccaatgctaatactggtactcttagtagtgctagtgttggtgatattgttaaagctaatggtggtgctgatgatgaggagaagaaattaggtttaccttctcatactgataaaaatcttttcacggtgctttatcaatatgagattgaaggtttggaggtgttaaccaaagatgaaaagtggataagattgaaaccatctcataactctttcgttgttatggctggagattccgcatatgcacttatgaatggtagactttttcgtccgtttcatcgagtaagagtaacggagaaaaagaagacaagatattcaatagcattattctcaactccaaacgcaggtaacatcatagaaccaccaaaagaacttgtggacgagaagcatccacgagtcttcaaaccattcacttatgttgacttgatgagtttctatcacactgaggctggtcgtagagctcgatctactcttcatgcttattgtgccgtctccgaagcatga

SEQ ID NO: 127 - DNA, 1320 bp, Brassica juncea
atgggtgcagacactcctcaacttccagtcatctatctctcggaccaaaccctgaaaccaggaagtgagaagtgggctgaagtcaggagtggtgtccgtaaagctctcgaagaatatggtgctttcgaggtgtcatatgatagagtgacagaggagcttaagaagtcagttttggatgccatgatagagcttttcgagttaccagttgaggctaaacagagaaacgtgtctccgaaaccctacatgggatattcgactcataatggtctctctgagagtctagggatccaggatcccaatgttttggagaaagttaacgaatttactcaactgctacgccctgattgtgagggtaacaagagtatgagcgaaacaatccagaagttttcagagaagttagtagaattggatgtaactgtgaaaagaatggtcatacagagctttgggatagagaactactttgatgaacacctcaagtcattgaagaattaccgtatgcgactgatgaagtacgtagcaccacctgatgttgatgctaaagatgctgatgatggtgccaatacgaatctgaatgctaacgctgatgcggatgctggtgctggtgatattgctaatggtattgctaatgttcatattgatgaagatgttaatgccaagggtgacgttggcactggtggtggtgatgctaatcataatggtgatgatgctaatactggtgattctgctagtgtaaagtcgaatgttgacgttggtactgatgttaatgttaaagctagtgttggtgctgatgttaacgttggcactattgctgatgctaatgctaatattggtactcttagtagtgctaatgttggcgttggggatagtgttaaagctaatggtggcgctgatgatgaggagaagaaattaggtttaccttctcatactgataaaaacctcttgacggtactttatcaatatgagattgatggtttggaggtgttgaccaaagatgaaaagtggatcaggttgaaaccagctcacaactctttcgttgttatagctggagattctctatatgcacttatgaatggtagactatctcgcccgtttcatagagtaagggtaacagaaagaaagaagacaaggtattcaatagcattgttctcggctccagacggagattacatcatcgaaccaccaaaagagcttgtggacgagaagcacccacgtctcttcaaaccattcacatatgctgacttgatgagtttctatcacactgaagctggtcgtagatctcgttctactcttgacgcttattctgctgtctctggagcataa

SEQ ID NO: 128 - protein, 428 aa, Brassica juncea
MGSDSTPQLPVIYLSDQTLKPGSEKWVEVRNDVRKALEDYGAFEVSYDRVSEELKQSVLEAMKELFELPVEAKRRNVSPKPYTGYSTHNGLSESLGIQDAEVLEKVNEFTQLLRPDFEGNKSISETIQKFSEKLAELDVMVRRMVMESFGIEKYFDEHLKSTNYRLRLMKYIAPPDVDTNVAAGANDAGDGSNDAGASDNANVVADTSDIASGIANVHINDDANIGATANGDIGADVDAKTSDFASVESKADVSTNVNANADANANTGTLSSAGVGDSVTANGGADDEEKKLGLPSHTDKNLFTVLYQYEIEGLEVLTKDEKWIRLKPSHNSFVVMAGDSVYALMNGRLFRPFHRVRVTEKKKTRYSIALFSTPNAGYIIEPPKELVDEKHPRVFKPFTYVDLMSFYHTEGGRRARSTLHAYCAVSEA

SEQ ID NO: 129 - protein, 435 aa, Brassica juncea
MAELDVMVRRMVFESFGIEDYFDENLKSMNYRLRLMKYSAPRDVDTNVAAGANDAGDAANTNNNGNTGADVGAGDSASTGDNDKVVASDDANAGADTNDIVVGIANVHIDDDANDVAKANGDVGAGVDANTNDCASVKSSADVDNVNANVSVGTNGDTNANVGADIEEKKLGLPSHTDKNLLTVLYQYEIEGLEVLTKDEKWIRVKPSHNTFVVIAGDSLHALMNGRLFLPFHRVRVTEKKKTRYSIGLFSTPNRDYIIEPPKELVDEQHPRVFKPLTYVDLMSFYHTEVGRRARSTLHAYCAVSGAMGSDSTPQLPVIHLSDQTLKPGSEKWVEVRSDVRKALEDYGAFEVSYDRVSEELKESVLEAMKELFQLPVEAKRRNVSPKPYTGYMTHNGISESLGIQDANVLEKVNEFTQLLRPDCEGNKSTRSVLL

SEQ ID NO: 130 - protein, 439 aa, Brassica juncea
MGADTPQLPVIYLSDQTLKPGSEKWVEVRSDVRKALEDYGGFEVSYDRVSEELKKSVLDAMIELFELPVEAKQRNVSPKPYTGYSTHNGLSESLGIQDSNVLEKVNEFTQLLRPDCEGNKTMSETIQNFSEKLAELDVMVRRMVIESFGIENYFDEHLKSTNYRLRLMKYVAPPDVDANVAVGTKDSDDGANTNTTANADADDIANGIAKVHIDDDADAKGDVCTGAGTNHNGDDVNTGDCANVKSNVDVGTNVSAKSSVGADVNTGTIDDVNANAGTRSSANVGVSDSVKANGGADDEEKKLGLPSHTDKNLLTVLYQYEIEGLEVLTKDEKWIRLKPSHNSFVVMAGDSLYALMNGRLSRPFHRVRVTERKKTRYSIALFSTPNGDYIIEPPKELVDEKHPRLFKPFTYVDLMSFYHTEAGRRARSTLHAYCAVSGA

SEQ ID NO: 131 - protein, 432 aa, Brassica juncea
MGSDSTPQLPVIYLSDQTLKPGSEKWVEVRSDVRKALEDYGAFEVSYDRVSEELKESVLEAMKELFDLPVEAKQRNVSPKPYTGYSTHNGLSESLGIQDAEVLEKVNEFTQLLRPDCEGNKSIRETIQKFSEKLAELDVMVRRMVMESFGIEKYFDEHLKSTNYRLRLMKYIAPPEVDTNVAVGANDAGDGANDASASDKANVVAGDEDNVGADTSDIANGIANVHIDDDAKANGDIGADVDAKTSDCANVESKADVSTDVNANSDSNANTGTLSSASVGDIVKANGGADDEEKKLGLPSHTDKNLFTVLYQYEIEGLEVLTKDEKWIRLKPSHNSFVVMAGDSAYALMNGRLFRPFHRVRVTEKKKTRYSIALFSTPNAGNIIEPPKELVDEKHPRVFKPFTYVDLMSFYHTEAGRRARSTLHAYCAVSEA

SEQ ID NO: 132 - protein, 439 aa, Brassica juncea
MGADTPQLPVIYLSDQTLKPGSEKWAEVRSGVRKALEEYGAFEVSYDRVTEELKKSVLDAMIELFELPVEAKQRNVSPKPYMGYSTHNGLSESLGIQDPNVLEKVNEFTQLLRPDCEGNKSMSETIQKFSEKLVELDVTVKRMVIQSFGIENYFDEHLKSLKNYRMRLMKYVAPPDVDAKDADDGANTNLNANADADAGAGDIANGIANVHIDEDVNAKGDVGTGGGDANHNGDDANTGDSASVKSNVDVGTDVNVKASVGADVNVGTIADANANIGTLSSANVGVGDSVKANGGADDEEKKLGLPSHTDKNLLTVLYQYEIDGLEVLTKDEKWIRLKPAHNSFVVIAGDSLYALMNGRLSRPFHRVRVTERKKTRYSIALFSAPDGDYIIEPPKELVDEKHPRLFKPFTYADLMSFYHTEAGRRSRSTLDAYSAVSGA

SEQ ID NO: 133 - DNA, 23 bp, Artificial
  spacer
agggtttggtccgagagatagat

SEQ ID NO: 134 - DNA, 23 bp, Artificial
  spacer
gggtttggtccgagagatggatg

SEQ ID NO: 135 - DNA, 23 bp, Artificial
  spacer
gggtttggtccgagagatagatc

SEQ ID NO: 136 - DNA, 23 bp, Artificial
  spacer
gaggtgtcatatgatagagtgac

SEQ ID NO: 137 - DNA, 23 bp, Artificial
  spacer
gaggtgtcatatgatagagtgtc

SEQ ID NO: 138 - DNA, 23 bp, Artificial
  spacer
atggcttccaaaaccgattcctt

SEQ ID NO: 139 - DNA, 23 bp, Artificial
  spacer
agagaagatggcagaattggatg

SEQ ID NO: 140 - DNA, 23 bp, Artificial
  spacer
atgagaacctcaagtcaatgaat

SEQ ID NO: 141 - DNA, 191 bp, Artificial
  mutated myrosinase
tcttatattattaataagagaagaaaaagatggttaattttagttacatgaattactgaaatgattctatattaatatgcacagacaagatttcaaagattatgccgatatatgtttcaaagaatttggtggaaaggtaaagtcgatctttacaggaccaaatataaggtgaatgctgtctccatatgtga

SEQ ID NO: 142 - DNA, 184 bp, Artificial
  mutated myrosinase
ttattaataagagaagaaaaagatggttaattttagttacatgcattacttaaatgattctatattaatatgcacagacaagatttcaaagattatgccgatctatgtttcaaagaatttggtggaaaggtaaagtcgatctttacaggaccaaatataaggtgaatgctgtctccatatgtga

SEQ ID NO: 143 - DNA, 173 bp, Artificial
  mutated myrosinase
agaagaaaaagatggttaattttagttacatgcattactgaaatgattctctattaatatgcacagacaagatttcaaagattatgccgatctatgtttcaacgaatttggtggaaaggtaaagtcgatctttacaggaccaaatataaggtgaatgctgtctccatatgtga

SEQ ID NO: 144 - DNA, 173 bp, Artificial
  mutated myrosinase
agaagaaaaagatggttaattttagttacatgcattactgaaatgattctctattaatatgcacagacaagatttcaaagattatgccgatctatgtttcaaagaatttggtggaaaggtaaagtcgatctttacaggaccaaatataaggtgaatgctgtctccatatgtga

SEQ ID NO: 145 - DNA, 147 bp, Artificial
  mutated myrosinase
tacatgcattactgaaatgattctatattaatatgcacagacaagatttccaagattatgccgatctatgtttcaaagaatttggtggaaaggtaaagtcgatctttacaggaccaaatataaggtgaatgctgtctccatatgtga

SEQ ID NO: 146 - DNA, 121 bp, Artificial
  mutated myrosinase
attaatatgcacagacaagatttcaaagattatgccgatctatgtttcaacgaatttggtggaaaggtaaagtcgatctttacaggaccaaatataaggtgaatgctgtctccatatgtga

SEQ ID NO: 147 - DNA, 101 bp, Artificial
  mutated myrosinase
tttcaaagattatgccgatctatgtttcaaagaatttggtggaaaggtaaagtcgatctttacaggaccaaatataaggtgaatgctgtctccatatgtga

SEQ ID NO: 148 - DNA, 101 bp, Artificial
  mutated myrosinase
aagaatttccggcgtaacatgtagaatcaacctttggagaacatcgaccagtgatcctaatccatagcctctcgtaggcactgagtagagctggttgattg

SEQ ID NO: 149 - DNA, 101 bp, Artificial
  mutated myrosinase
gcaccaccttaatatggagagaccactcaccttatatttggtcctgtaaagaaccataggagaacatcgaccgggtgcatctgttccgaccgcatagcctc

SEQ ID NO: 150 - DNA, 101 bp, Artificial
  mutated myrosinase
tctgttccgaccgcatagcctctcgtagggactgtgtatagctggttgatcgtgctttacctttccaccaaattctttgaaacatagatccgcgtagtctt

SEQ ID NO: 151 - DNA, 101 bp, Artificial
  mutated myrosinase
gctatgcgatcggaacagatgcacccggtcgatgttctcctatggttgattcaggtgttacggcggaaattcttcaacagaaccctacatcgttgcacata

SEQ ID NO: 152 - DNA, 101 bp, Artificial
  mutated myrosinase
tcttcaacagaaccctacatcgttgcacataaccagcttcttgctcatgcatcgatctttacaggaccaaatataaggtgagtggcctccatatgtgaaaa

SEQ ID NO: 153 - DNA, 101 bp, Artificial; identical to SEQ ID NO: 147
  mutated myrosinase

SEQ ID NO: 154 - DNA, 101 bp, Artificial
  mutated myrosinase
agatttcaaagactatgcggatctatgtttcaaagaatttggtggaaaggttcacgatcaaccagctattcacagtgcctacgagaggctatgcactcgga

SEQ ID NO: 155 - DNA, 101 bp, Artificial
  mutated myrosinase
gaagaatttccggcgtaacatgtaggatcaacctttggagaacatcgaccatgatcctaatccatagcctctcgtaggcactgagtagagctggttgattg

SEQ ID NO: 156 - DNA, 101 bp, Artificial
  mutated myrosinase
aagaatttccggcgtaacatgtagaatcaacctttggagaacatcgaccaggcatctgatcctaatccatagcctctcgtaggcactgagtagagctggtt

SEQ ID NO: 157 - DNA, 101 bp, Artificial
  mutated myrosinase
gcaccaccttaatatggagagaccactcaccttatatttggtcctgtaaagcgtggcatgagcaagaagctggttatgtgcaacgatgtagggttctgttg

SEQ ID NO: 158 - DNA, 101 bp, Artificial
  mutated myrosinase
gtgcatctgttccgaccgcatagcctctcgtagggactgtgtatagctggttgctttacctttccaccaaattctttgaaacatagatccgcgtagtcttt

SEQ ID NO: 159 - DNA, 101 bp, Artificial
  mutated myrosinase
tgttccgaccgcatagcctctcgtagggactgtgtatagctggttgatcgtctttacctttccaccaaattctttgaaacatagatccgcgtagtctttga

SEQ ID NO: 160 - DNA, 101 bp, Artificial
  mutated myrosinase
atctttatcacgtattgagacaactcaccttgtatttggtcctgtaaagatcgtggcatgagcaagaagctggttatgtgcaacgatgtagggttctgttg

SEQ ID NO: 161 - DNA, 102 bp, Artificial
  mutated myrosinase
gaggctatgcgatcggaacagatgcacccggtcgatgttctcctatggttaccgatctttacaggaccaaatataaggtgagtggcctccatatgtgaaaag

SEQ ID NO: 162 - DNA, 171 bp, Artificial
  mutated myrosinase
tgcgatcggaacagatgcacccggtcgatgttctcctatggttgataccacaggtgttacggcggaaattcttcaacagaaccctacatcgttgcacataaccagcttcttgctcatgccaaccaaatataaggtgagtggcctccatatgtgaaaaggtggtctaaatct

SEQ ID NO: 163 - DNA, 101 bp, Artificial
  mutated myrosinase
gatttcaaagattatgccgatctatgtttcaaagaatttggtggaaaggtagatcacgatcaaccagctatacacagtccctacgagaggctatgcagtcg

SEQ ID NO: 164 - DNA, 101 bp, Artificial
  mutated myrosinase
cttcaacagaaccctatatcgttgcacataaccagcttcttgctcatgccacgatctttacaggaccaaatataaggtgaatgctgtctccatatgtgaaa

SEQ ID NO: 165 - DNA, 101 bp, Artificial
  mutated myrosinase
ggtgcatctgttccgagtgcatagcctctcgtaggcactgtgtatagctggttctttgaaacatagatccgcgtaatctttgaaatcttggctgtgcatat

SEQ ID NO: 166 - DNA, 101 bp, Artificial
  mutated myrosinase
cacatatggagtcaccactcaccttatatttggtcctgtaaagatcgacgcggcatgagcaagaagctggttatgtgcaacgatgtagggttctgttgaag

SEQ ID NO: 167 - DNA, 101 bp, Artificial
  mutated myrosinase
aagaatgattatatattaatatgcacagacaagatttcaaagactatgcgggcctacgagaggctatgcactcggaacagatgcacccggtagatgttctc

SEQ ID NO: 168 - DNA, 101 bp, Artificial
  mutated myrosinase
agatttcaaagactatgcggatctatgtttcaaagaatttggtggaaaggtacgatcaaccagctattcacagtgcctacgagaggctatgcactcggaac

SEQ ID NO: 169 - DNA, 101 bp, Artificial
  mutated myrosinase
gctggttatgtgcaactatataaggttctgttgaagaatttccgccgtaacaccttcggagaacatcgaccgggtgcatctgttccgattgcatagcctct

SEQ ID NO: 170 - DNA, 101 bp, Artificial
  mutated myrosinase
gttatgtgcaactatataaggttctgttgaagaatttccgccgtaacatctcttcggagaacatcgaccgggtgcatctgttccgattgcatagcctctcg

SEQ ID NO: 171 - DNA, 101 bp, Artificial
  mutated myrosinase
tgcatctgttccgattgcatagcctctcgtaggcactgtgtacagctggttacctttccaccaaattccttgaaacatagatccgcataatctctaaagtc

SEQ ID NO: 172 - DNA, 101 bp, Artificial
  mutated myrosinase
tgttccgattgcatagcctctcgtaggcactgtgtacagctggttaatcgatcttcacctttccaccaaattccttgaaacatagatccgcataatctcta

SEQ ID NO: 173 - DNA, 101 bp, Artificial
  mutated myrosinase
tgaagaatttccggcgtaacatgtaggatcaacctttggagaacatcgaccatcctaatccatagcctctcgtaggcactgagtagagctggttgattgtg

SEQ ID NO: 174 - DNA, 101 bp, Artificial
  mutated myrosinase
gaagaatttccggcgtaacatgtaggatcaacctttggagaacatcgaccaatcctaatccatagcctctcgtaggcactgagtagagctggttgattgtg

SEQ ID NO: 175 - DNA, 101 bp, Artificial
  mutated myrosinase
ctgatcctaatccatagcctctcgtaggcactgagtagagctggttgattgtactttgtcaccaaattcttcgaaacatagatccgcgtaatctctgaaat

SEQ ID NO: 176 - DNA, 101 bp, Artificial
  mutated myrosinase
ttccgaccgcatagcctctcgtagggactgtgtatagctggttgatcgtgatacctttccaccaaattctttgaaacatagatccgcgtagtctttgaaat

SEQ ID NO: 177 - DNA, 101 bp, Artificial
  mutated myrosinase
ttatcacgtattgagacaactcaccttgtatttggtcctgtaaagatcgacggcatgagcaagaagctggttatgtgcaacgatgtagggttctgttgaag

SEQ ID NO: 178 - DNA, 113 bp, Artificial
  mutated myrosinase
accgggtgcatctgttccgaccgcatagcctctcgtagggactgtgtataactggttgatcgtctttacctttccaccaaattctttgaaacatagatccgcgtaatctttga

SEQ ID NO: 179 - DNA, 101 bp, Artificial
  mutated myrosinase
atttcaaagattatgccgatctatgtttcaaagaatttggtggaaaggtaaatcaaccagctatacacagtccctacgagaggctatgcagtcggaacaga

SEQ ID NO: 180 - DNA, 101 bp, Artificial
  mutated myrosinase
ttccgctcgcatagcctcttgtcggcactgtatatagctggttgatcgtgagctttacctttccaccaaattcattgaaacatagatccgcgtaatctttg

SEQ ID NO: 181 - DNA, 101 bp, Artificial
  mutated myrosinase
agctggttatgtgcaactatataaggttctgttgaagaatttccgccgtaacttcggagaacatcgaccgggtgcatctgttccgattgcatagcctctcg

SEQ ID NO: 182 - DNA, 101 bp, Artificial
  mutated myrosinase
gatcctaatccatagcctctcgtaggcactgagtagagctggttgattgtggctttactttgtcaccaaattcttcgaaacatagatccgcgtaatctctg

SEQ ID NO: 183 - DNA, 101 bp, Artificial; identical to SEQ ID NO: 177
  mutated myrosinase

SEQ ID NO: 184 - DNA, 113 bp, Artificial; identical to SEQ ID NO: 178
  mutated myrosinase

SEQ ID NO: 185 - DNA, 120 bp, Artificial
  mutated myrosinase
attaatatgcacagacaagatttcaaagattatgccgatctatgtttcaacgaatttggtggaaaggtaaatcaaccagctatacacagtccctacgagaggctatgcagtcggaacaga

SEQ ID NO: 186 - DNA, 101 bp, Artificial; identical to SEQ ID NO: 179
  mutated myrosinase

SEQ ID NO: 187 - DNA, 101 bp, Artificial; identical to SEQ ID NO: 176
  mutated myrosinase

SEQ ID NO: 188 - DNA, 101 bp, Artificial; identical to SEQ ID NO: 177
  mutated myrosinase

SEQ ID NO: 189 - DNA, 113 bp, Artificial; identical to SEQ ID NO: 178
  mutated myrosinase

SEQ ID NO: 190 - DNA, 101 bp, Artificial; identical to SEQ ID NO: 179
  mutated myrosinase

SEQ ID NO: 191 - DNA, 101 bp, Artificial; identical to SEQ ID NO: 180
  mutated myrosinase

SEQ ID NO: 192 - DNA, 101 bp, Artificial; identical to SEQ ID NO: 181
  mutated myrosinase

SEQ ID NO: 193 - DNA, 170 bp, Artificial
  mutated myrosinase
ttggtcacgtgatatatatatatatatgactatacattagaatcagatatcttagattacactacaccatctttatcacgtattgagacaactcaccttgtatttggtcctgtaaagatcgtgctttacctttccaccaaattctttgaaacatagatccgcgtagtctt

SEQ ID NO: 194 - DNA, 101 bp, Artificial
  mutated myrosinase
acaccatctttatcacgtattgagacaactcaccttgtatttggtcctgtaatgtgcaacgatgtagggttctgttgaagaatttccaccgtaacacctgt

SEQ ID NO: 195 - DNA, 113 bp, Artificial
  mutated myrosinase
accgggtgcatctgttccgaccgcatagcctctcgtagggactgtgtataactggttgatcgtgtgctttacctttccaccaaattctttgaaacatagatccgcgtaatctt

SEQ ID NO: 196 - DNA, 101 bp, Artificial
  mutated myrosinase
gaggctatgcgatcggaacagatgcacccggtcgatgttctcctatggttgacaggtgttacggcggaaattcttcaacagaaccctacatcgttgcacat

SEQ ID NO: 197 - DNA, 101 bp, Artificial
  mutated myrosinase
acccggtcgatgttctcctatggttgataccaagcacaggtgttacggcgtaaattcttcaacagaaccctacatcgttgcacataaccagcttcttgctc

SEQ ID NO: 198 - DNA, 101 bp, Artificial
  mutated myrosinase
ttcttcaacagaaccctacatcgttgcacataaccagcttcttgctcatgccgtcgatctttacaggaccaaatataaggtgagtggcctccatatgtgaa

SEQ ID NO: 199 - DNA, 101 bp, Artificial
  mutated myrosinase
cttcaacagaaccctacatcgttgcacataaccagcttcttgctcatgccacgatctttacaggaccaaatataaggtgagtggcctccatatgtgaaaag

SEQ ID NO: 200 - DNA, 101 bp, Artificial; identical to SEQ ID NO: 147
  mutated myrosinase

SEQ ID NO: 201 - DNA, 194 bp, Artificial
  mutated myrosinase
tcttgttatcatcacaggtccaatcttcccgttttggaactgttggtcacatgatatatatgactagatcagaatcagatggattaagatcacaccatcgtattaaatatggagactactcaccttatagttggtcctgtgtaatctttgaaacatagatccgcgtaatctttgaaatcctggctgttcatatt

SEQ ID NO: 202 - DNA, 231 bp, Artificial
  mutated myrosinase
tgagtatgaaggttttttggatcgccagatcatgtatgtgccatgcttctgaggagagtaaatattattagtaatagaagaagaagatttagtcttaattacatgtttactgaaatgattctatactaatatgaacagccaggatttcaaagattacgcggatctatgtttcaaagattacacaggaccaactataaggtgagtagtctccatatttaatacgatggtgtg

SEQ ID NO: 203 - DNA, 233 bp, Artificial
  mutated myrosinase
aggttttttggatcgccagatcatgtatgtgccatgcttcttaattatatttgaggagagtaaatattattagtaatagaagaagaagatttagtcttaattacatgtttactgaaatgattctatactaatatgaacagccaggatttcaaagattacgcggatctatgtttcaaagattacacaggaccaactataaggtgagtagtctccatatttaatacgatggtgtg

SEQ ID NO: 204 - DNA, 101 bp, Artificial; identical to SEQ ID NO: 170
  mutated myrosinase

SEQ ID NO: 205 - DNA, 101 bp, Artificial
  mutated myrosinase
gtgcatctgttccgattgcatagcctctcgtaggcactgtgtacagctggtttcttcacctttccaccaaattccttgaaacatagatccgcataatctct

SEQ ID NO: 206 - DNA, 101 bp, Artificial
  mutated myrosinase
atcctaatccatagcctctcgtaggcactgagtagagctggttgattgtgagctttactttgtcaccaaattcttcgaaacatagatccgcgtaatctctg

SEQ ID NO: 207 - DNA, 101 bp, Artificial; identical to SEQ ID NO: 194
  mutated myrosinase

SEQ ID NO: 208 - DNA, 113 bp, Artificial; identical to SEQ ID NO: 195
  mutated myrosinase

SEQ ID NO: 209 - DNA, 101 bp, Artificial; identical to SEQ ID NO: 196
  mutated myrosinase

SEQ ID NO: 210 - DNA, 101 bp, Artificial; identical to SEQ ID NO: 198
  mutated myrosinase

SEQ ID NO: 211 - DNA, 101 bp, Artificial; identical to SEQ ID NO: 199
  mutated myrosinase

SEQ ID NO: 212 - DNA, 194 bp, Artificial; identical to SEQ ID NO: 201
  mutated myrosinase

SEQ ID NO: 213 - DNA, 231 bp, Artificial; identical to SEQ ID NO: 202
  mutated myrosinase

SEQ ID NO: 214 - DNA, 233 bp, Artificial; identical to SEQ ID NO: 203
  mutated myrosinase

SEQ ID NO: 215 - DNA, 101 bp, Artificial; identical to SEQ ID NO: 170
  mutated myrosinase

SEQ ID NO: 216 - DNA, 101 bp, Artificial; identical to SEQ ID NO: 205
  mutated myrosinase

SEQ ID NO: 217 - DNA, 101 bp, Artificial; identical to SEQ ID NO: 206
  mutated myrosinase

SEQ ID NO: 218 - DNA, 101 bp, Artificial; identical to SEQ ID NO: 148
  mutated myrosinase

SEQ ID NO: 219 - DNA, 101 bp, Artificial; identical to SEQ ID NO: 149
  mutated myrosinase

SEQ ID NO: 220 - DNA, 101 bp, Artificial; identical to SEQ ID NO: 150
  mutated myrosinase

SEQ ID NO: 221 - DNA, 101 bp, Artificial; identical to SEQ ID NO: 151
  mutated myrosinase

SEQ ID NO: 222 - DNA, 101 bp, Artificial; identical to SEQ ID NO: 152
  mutated myrosinase

SEQ ID NO: 223 - DNA, 101 bp, Artificial; identical to SEQ ID NO: 147
  mutated myrosinase

SEQ ID NO: 224 - DNA, 101 bp, Artificial
  mutated myrosinase
tggttatgtgcaacgatgtagggttctgttgaagaatttccgccgtaacaccaaccataggagaacatcgaccgggtgcatctgttccgactgcatagcct

SEQ ID NO: 225 - DNA, 101 bp, Artificial; identical to SEQ ID NO: 154
  mutated myrosinase

SEQ ID NO: 226 - DNA, 123 bp, Artificial
  mutated myrosinase
acaaacctatatatactcaccttatattttgtcctgtaaacatcgaccgcttatataaggtgagtatagttgcacatacatgatggtgcggttcaagaaaccttcatactcatcttgcagtgt

SEQ ID NO: 227 - DNA, 101 bp, Artificial; identical to SEQ ID NO: 155
  mutated myrosinase

SEQ ID NO: 228 - DNA, 101 bp, Artificial; identical to SEQ ID NO: 148
  mutated myrosinase

SEQ ID NO: 229 - DNA, 101 bp, Artificial; identical to SEQ ID NO: 149
  mutated myrosinase

SEQ ID NO: 230 - DNA, 101 bp, Artificial; identical to SEQ ID NO: 150
  mutated myrosinase

SEQ ID NO: 231 - DNA, 101 bp, Artificial; identical to SEQ ID NO: 151
  mutated myrosinase

SEQ ID NO: 232 - DNA, 101 bp, Artificial; identical to SEQ ID NO: 152
  mutated myrosinase

SEQ ID NO: 233 - DNA, 101 bp, Artificial; identical to SEQ ID NO: 147
  mutated myrosinase

SEQ ID NO: 234 - DNA, 101 bp, Artificial; identical to SEQ ID NO: 224
  mutated myrosinase

SEQ ID NO: 235 - DNA, 101 bp, Artificial; identical to SEQ ID NO: 154
  mutated myrosinase

SEQ ID NO: 236 - DNA, 101 bp, Artificial; identical to SEQ ID NO: 155
  mutated myrosinase

SEQ ID NO: 237 - DNA, 101 bp, Artificial; identical to SEQ ID NO: 160
  mutated myrosinase

SEQ ID NO: 238 - DNA, 111 bp, Artificial
  mutated myrosinase
accgggtgcatctgttccgaccgcatagcctctcgtagggactgtgtataactggttgatcatcttgtctgcatatgaatatataattatttcagttaatacatgtaatta

SEQ ID NO: 239 - DNA, 101 bp, Artificial
  mutated myrosinase
aggctatgcgatcggaacagatgcacccggtcgatgttctcctatggttgaacaggtgttacggcggaaattcttcaacagaaccctacatcgttgcacat

SEQ ID NO: 240 - DNA, 101 bp, Artificial
  mutated myrosinase
agatttcaaagattatgccgatctatgtttcaaagaatttggtggaaaggtaaccagctatacacagtccctacgagaggctatgcagtcggaacagatgc

SEQ ID NO: 241 - DNA, 101 bp, Artificial
  mutated myrosinase
cttcaacagaaccctatatcgttgcacataaccagcttcttgctcatgccacgtcgatctttacaggaccaaatataaggtgaatgctgtctccatatgtg

SEQ ID NO: 242 - DNA, 101 bp, Artificial
  mutated myrosinase
tcaaagactatgcggatctatgtttcaaagaatttggtggaaaggtaaagcgatcacgatcaaccagctattcacagtgcctacgagaggctatgcactcg

SEQ ID NO: 243 - DNA, 101 bp, Artificial
  mutated myrosinase
ctggttatgtgcaactatataaggttctgttgaagaatttccgccgtaacattcggagaacatcgaccgggtgcatctgttccgattgcatagcctctcgt

SEQ ID NO: 244 - DNA, 101 bp, Artificial
  mutated myrosinase
ccgattgcatagcctctcgtaggcactgtgtacagctggttaatcgtgatccttcacctttccaccaaattccttgaaacatagatccgcataatctctaa

SEQ ID NO: 245 - DNA, 101 bp, Artificial
  mutated myrosinase
gaagaatttccggcgtaacatgtaggatcaacctttggagaacatcgaccagatcctaatccatagcctctcgtaggcactgagtagagctggttgattgt

SEQ ID NO: 246 - DNA, 101 bp, Artificial
  mutated myrosinase
ggtgcatctgatcctaatccatagcctctcgtaggcactgagtagagctgtttcgaaacatagatccgcgtaatctctgaaatcatctctgcgagtattat

SEQ ID NO: 247 - DNA, 101 bp, Artificial
  mutated myrosinase
ctgatcctaatccatagcctctcgtaggcactgagtagagctggttgattggtcaccaaattcttcgaaacatagatccgcgtaatctctgaaatcatctc

SEQ ID NO: 248 - DNA, 101 bp, Artificial; identical to SEQ ID NO: 160
  mutated myrosinase

SEQ ID NO: 249 - DNA, 111 bp, Artificial; identical to SEQ ID NO: 238
  mutated myrosinase

SEQ ID NO: 250 - DNA, 101 bp, Artificial; identical to SEQ ID NO: 239
  mutated myrosinase

SEQ ID NO: 251 - DNA, 101 bp, Artificial; identical to SEQ ID NO: 240
  mutated myrosinase

SEQ ID NO: 252 - DNA, 101 bp, Artificial; identical to SEQ ID NO: 241
  mutated myrosinase

SEQ ID NO: 253 - DNA, 101 bp, Artificial; identical to SEQ ID NO: 242
  mutated myrosinase

SEQ ID NO: 254 - DNA, 101 bp, Artificial; identical to SEQ ID NO: 243
  mutated myrosinase

SEQ ID NO: 255 - DNA, 101 bp, Artificial; identical to SEQ ID NO: 244
  mutated myrosinase

SEQ ID NO: 256 - DNA, 101 bp, Artificial; identical to SEQ ID NO: 245
  mutated myrosinase

SEQ ID NO: 257 - DNA, 101 bp, Artificial; identical to SEQ ID NO: 246
  mutated myrosinase

SEQ ID NO: 258 - DNA, 101 bp, Artificial; identical to SEQ ID NO: 247
  mutated myrosinase

SEQ ID NO: 259 - DNA, 101 bp, Artificial; identical to SEQ ID NO: 156
  mutated myrosinase

SEQ ID NO: 260 - DNA, 101 bp, Artificial; identical to SEQ ID NO: 157
  mutated myrosinase

SEQ ID NO: 261 - DNA, 101 bp, Artificial; identical to SEQ ID NO: 158
  mutated myrosinase

SEQ ID NO: 262 - DNA, 101 bp, Artificial; identical to SEQ ID NO: 159
  mutated myrosinase

SEQ ID NO: 263 - DNA, 101 bp, Artificial; identical to SEQ ID NO: 160
  mutated myrosinase

SEQ ID NO: 264 - DNA, 102 bp, Artificial; identical to SEQ ID NO: 161
  mutated myrosinase

SEQ ID NO: 265 - DNA, 171 bp, Artificial; identical to SEQ ID NO: 162
  mutated myrosinase

SEQ ID NO: 266 - DNA, 101 bp, Artificial; identical to SEQ ID NO: 163
  mutated myrosinase

SEQ ID NO: 267 - DNA, 101 bp, Artificial; identical to SEQ ID NO: 164
  mutated myrosinase

SEQ ID NO: 268 - DNA, 101 bp, Artificial; identical to SEQ ID NO: 165
  mutated myrosinase

SEQ ID NO: 269 - DNA, 101 bp, Artificial; identical to SEQ ID NO: 166
  mutated myrosinase

SEQ ID NO: 270 - DNA, 101 bp, Artificial; identical to SEQ ID NO: 167
  mutated myrosinase

SEQ ID NO: 271 - DNA, 101 bp, Artificial; identical to SEQ ID NO: 168
  mutated myrosinase

SEQ ID NO: 272 - DNA, 101 bp, Artificial; identical to SEQ ID NO: 169
  mutated myrosinase

SEQ ID NO: 273 - DNA, 101 bp, Artificial; identical to SEQ ID NO: 170
  mutated myrosinase

SEQ ID NO: 274 - DNA, 101 bp, Artificial; identical to SEQ ID NO: 171
  mutated myrosinase

SEQ ID NO: 275 - DNA, 101 bp, Artificial; identical to SEQ ID NO: 172
  mutated myrosinase

SEQ ID NO: 276 - DNA, 101 bp, Artificial; identical to SEQ ID NO: 173
  mutated myrosinase

SEQ ID NO: 277 - DNA, 101 bp, Artificial; identical to SEQ ID NO: 174
  mutated myrosinase

SEQ ID NO: 278 - DNA, 101 bp, Artificial; identical to SEQ ID NO: 175
  mutated myrosinase

SEQ ID NO: 279 - DNA, 101 bp, Artificial; identical to SEQ ID NO: 156
  mutated myrosinase

SEQ ID NO: 280 - DNA, 101 bp, Artificial; identical to SEQ ID NO: 157
  mutated myrosinase

SEQ ID NO: 281 - DNA, 101 bp, Artificial; identical to SEQ ID NO: 158
  mutated myrosinase

SEQ ID NO: 282 - DNA, 101 bp, Artificial; identical to SEQ ID NO: 159
  mutated myrosinase

SEQ ID NO: 283 - DNA, 101 bp, Artificial; identical to SEQ ID NO: 160
  mutated myrosinase

SEQ ID NO: 284 - DNA, 102 bp, Artificial; identical to SEQ ID NO: 161
  mutated myrosinase

SEQ ID NO: 285 - DNA, 171 bp, Artificial; identical to SEQ ID NO: 162
  mutated myrosinase

SEQ ID NO: 286 - DNA, 101 bp, Artificial; identical to SEQ ID NO: 163
  mutated myrosinase

SEQ ID NO: 287 - DNA, 101 bp, Artificial; identical to SEQ ID NO: 164
  mutated myrosinase

SEQ ID NO: 288 - DNA, 101 bp, Artificial; identical to SEQ ID NO: 165
  mutated myrosinase

SEQ ID NO: 289 - DNA, 101 bp, Artificial; identical to SEQ ID NO: 166
  mutated myrosinase

SEQ ID NO: 290 - DNA, 101 bp, Artificial; identical to SEQ ID NO: 167
  mutated myrosinase

SEQ ID NO: 291 - DNA, 101 bp, Artificial; identical to SEQ ID NO: 168
  mutated myrosinase

SEQ ID NO: 292 - DNA, 101 bp, Artificial; identical to SEQ ID NO: 169
  mutated myrosinase

SEQ ID NO: 293 - DNA, 101 bp, Artificial; identical to SEQ ID NO: 170
  mutated myrosinase

SEQ ID NO: 294 - DNA, 101 bp, Artificial; identical to SEQ ID NO: 171
  mutated myrosinase

SEQ ID NO: 295 - DNA, 101 bp, Artificial; identical to SEQ ID NO: 172
  mutated myrosinase

SEQ ID NO: 296 - DNA, 101 bp, Artificial; identical to SEQ ID NO: 173
  mutated myrosinase

SEQ ID NO: 297 - DNA, 101 bp, Artificial; identical to SEQ ID NO: 174
  mutated myrosinase

SEQ ID NO: 298 - DNA, 101 bp, Artificial; identical to SEQ ID NO: 175
  mutated myrosinase

SEQ ID NO: 299 - DNA, 101 bp, Artificial; identical to SEQ ID NO: 160
  mutated myrosinase

SEQ ID NO: 300 - DNA, 111 bp, Artificial; identical to SEQ ID NO: 238
  mutated myrosinase

SEQ ID NO: 301 - DNA, 101 bp, Artificial; identical to SEQ ID NO: 239
  mutated myrosinase

SEQ ID NO: 302 - DNA, 101 bp, Artificial; identical to SEQ ID NO: 240
  mutated myrosinase

SEQ ID NO: 303 - DNA, 101 bp, Artificial; identical to SEQ ID NO: 241
  mutated myrosinase

SEQ ID NO: 304 - DNA, 101 bp, Artificial
  mutated myrosinase
aaccctatatcgttgcacataaccagcttcttgctcatgccacggtcgtcaatctttacaggaccaaatataaggtgaatgctgtctccatatgtgaaaat

SEQ ID NO: 305 - DNA, 101 bp, Artificial; identical to SEQ ID NO: 242
  mutated myrosinase

SEQ ID NO: 306 - DNA, 101 bp, Artificial; identical to SEQ ID NO: 243
  mutated myrosinase

SEQ ID NO: 307 - DNA, 101 bp, Artificial; identical to SEQ ID NO: 244
  mutated myrosinase

SEQ ID NO: 308 - DNA, 141 bp, Artificial
  mutated myrosinase
agaatttccggcgtaacatgtaggatcaacctttggagaacatcgaccagatcctaatccatagcctctcgtaggcactgagtagagctgtttcgaaacatagatccgcgtaatctctgaaatcatctctgcgagtattat

SEQ ID NO: 309 - DNA, 101 bp, Artificial; identical to SEQ ID NO: 247
  mutated myrosinase

SEQ ID NO: 310 - DNA, 101 bp, Artificial; identical to SEQ ID NO: 160
  mutated myrosinase

SEQ ID NO: 311 - DNA, 111 bp, Artificial; identical to SEQ ID NO: 238
  mutated myrosinase

SEQ ID NO: 312 - DNA, 101 bp, Artificial; identical to SEQ ID NO: 239
  mutated myrosinase

SEQ ID NO: 313 - DNA, 101 bp, Artificial; identical to SEQ ID NO: 240
  mutated myrosinase

SEQ ID NO: 314 - DNA, 101 bp, Artificial; identical to SEQ ID NO: 241
  mutated myrosinase

SEQ ID NO: 315 - DNA, 101 bp, Artificial; identical to SEQ ID NO: 242
  mutated myrosinase

SEQ ID NO: 316 - DNA, 101 bp, Artificial; identical to SEQ ID NO: 243
  mutated myrosinase

SEQ ID NO: 317 - DNA, 101 bp, Artificial; identical to SEQ ID NO: 244
  mutated myrosinase

SEQ ID NO: 318 - DNA, 141 bp, Artificial; identical to SEQ ID NO: 308
  mutated myrosinase

SEQ ID NO: 319 - DNA, 101 bp, Artificial; identical to SEQ ID NO: 247
  mutated myrosinase

SEQ ID NO: 320 - DNA, 101 bp, Artificial; identical to SEQ ID NO: 176
  mutated myrosinase

SEQ ID NO: 321 - DNA, 115 bp, Artificial
  mutated myrosinase
ccgaccgcatagcctctcgtagggactgtgtatagctggttgatcgtgatacctttccaccaaagtctttgaaacatagatccgcgtagtctttgaaatcttgtctgtgcatatt

SEQ ID NO: 322 - DNA, 101 bp, Artificial; identical to SEQ ID NO: 177
  mutated myrosinase

SEQ ID NO: 323 - DNA, 113 bp, Artificial; identical to SEQ ID NO: 178
  mutated myrosinase

SEQ ID NO: 324 - DNA, 120 bp, Artificial; identical to SEQ ID NO: 185
  mutated myrosinase

SEQ ID NO: 325 - DNA, 101 bp, Artificial; identical to SEQ ID NO: 179
  mutated myrosinase

SEQ ID NO: 326 - DNA, 101 bp, Artificial
  mutated myrosinase
aaccagcttcttgctcatgccacggtcgtcgatctttacaggaccaaatacaaggtgaatgctgtctccatatgtgaaaattaaggtggtgtctaacatat

SEQ ID NO: 327 - DNA, 101 bp, Artificial
  mutated myrosinase
atgttagatttgcaccaccttaatatggagagaccactcaccttatattttgtcctgtaaagatcgacgaccgtggcatgagcaagaagctggttatgtgc

SEQ ID NO: 328 - DNA, 101 bp, Artificial
  mutated myrosinase
ttagatttgcaccaccttaatatggagagaccactcaccttatatttggttctgtaaagatcgacgaccgtggcatgagcaagaagctggttatgtgcaac

SEQ ID NO: 329 - DNA, 101 bp, Artificial
  mutated myrosinase
caccttaatatggagagaccactcaccttatatttggtcctgtaaagatctacgaccgtggcatgagcaagaagctggttatgtgcaacgatgtagggttc

SEQ ID NO: 330 - DNA, 101 bp, Artificial
  mutated myrosinase
tatggagagaccactcaccttatatttggtcctgtaaagatcgacgaccggggcatgagcaagaagctggttatgtgcaacgatgtagggttctgttgaag

SEQ ID NO: 331 - DNA, 101 bp, Artificial; identical to SEQ ID NO: 176
  mutated myrosinase

SEQ ID NO: 332 - DNA, 101 bp, Artificial
  mutated myrosinase
ccgaccgcatagcctctcgtagggactgtgtatagctggttgatcgtgattcctttccaccaaattctttgaaacatagatccgcgtagtctttgaaatct

SEQ ID NO: 333 - DNA, 101 bp, Artificial
  mutated myrosinase
agcctctcgtagggactgtgtatagctggttgatcgtgatccagtgcttttcctttccaccaaattctttgaaacatagatccgcgtagtctttgaaatct

SEQ ID NO: 334 - DNA, 101 bp, Artificial; identical to SEQ ID NO: 177
  mutated myrosinase

SEQ ID NO: 335 - DNA, 113 bp, Artificial
  mutated myrosinase
atcacgtattgagacaactcaccttgtatttggtcctgtaaagatcgacggcatgagcaagacgctggttatgtgcaacgatgtagggttctgttgaagaatttccaccgtaa

SEQ ID NO: 336 - DNA, 113 bp, Artificial; identical to SEQ ID NO: 178
  mutated myrosinase

SEQ ID NO: 337 - DNA, 101 bp, Artificial
  mutated myrosinase
acagatgcacccggtcgatgttctcctatggttgataccaagcacaggtggtacggcggaaattcttcaacagaaccctacatcgttgcacataaccagct

SEQ ID NO: 338 - DNA, 101 bp, Artificial
  mutated myrosinase
ggaaattcttcaacagaaccctacatcgttgcacataaccagcttcttgcgcatgccacggtcgtcgatctttacaggaccaaatataaggtgagtggcct

SEQ ID NO: 339 - DNA, 101 bp, Artificial
  mutated myrosinase
cttcaacagaaccctacatcgttgcacataaccagcttcttgctcatgccccggtcgtcgatctttacaggaccaaatataaggtgagtggcctccatatg

SEQ ID NO: 340 - DNA, 101 bp, Artificial
  mutated myrosinase
cctacatcgttgcacataaccagcttcttgctcatgccacggtcgtcgatatttacaggaccaaatataaggtgagtggcctccatatgtgaaaaggtggt

SEQ ID NO: 341 - DNA, 101 bp, Artificial
  mutated myrosinase
tgcacataaccagcttcttgctcatgccacggtcgtcgatctttacaggaacaaatataaggtgagtggcctccatatgtgaaaaggtggtctaaatctaa

SEQ ID NO: 342 - DNA, 101 bp, Artificial; identical to SEQ ID NO: 179
  mutated myrosinase

SEQ ID NO: 343 - DNA, 101 bp, Artificial
  mutated myrosinase
gaaccctatatcgttgcacataaccagcttcttgctcatgccacggtcgtagatctttacaggaccaaatataaggtgaatgctgtctccatatgtgaaaa

SEQ ID NO: 344 - DNA, 101 bp, Artificial
  mutated myrosinase
ggcatgagcaagaagctggttatgtgcaacgatgtagggttctgttgaagcatttccgccgtaacacctgtgcttggtatcaaccatataagaacatcgac

SEQ ID NO: 345 - DNA, 101 bp, Artificial
  mutated myrosinase
tatgtgcaacgatgtagggttctgttgaagaatttccgccgtaacacctgcgcttggtatcaaccatataagaacatcgaccgggtgcatctgttccgctc

SEQ ID NO: 346 - DNA, 101 bp, Artificial
  mutated myrosinase
tatgtgcaacgatgtagggttctgttgaagaatttccgccgtaacacctgggcttggtatcaaccatataagaacatcgaccgggtgcatctgttccgctc

SEQ ID NO: 347 - DNA, 101 bp, Artificial
  mutated myrosinase
tgcaacgatgtagggttctgttgaagaatttccgccgtaacacctgtgctgggtatcaaccatataagaacatcgaccgggtgcatctgttccgctcgcat

SEQ ID NO: 348 - DNA, 101 bp, Artificial
  mutated myrosinase
gtgcatctgttccgctcgcatagcctcttgtcggcactgtatatagctgggtgatcgtgatccagtgctttacctttccaccaaattcattgaaacataga

SEQ ID NO: 349 - DNA, 101 bp, Artificial
  mutated myrosinase
agcctcttgtcggcactgtatatagctggttgatcgtgatccagtgctttccctttccaccaaattcattgaaacatagatccgcgtaatctttgaaatct

SEQ ID NO: 350 - DNA, 101 bp, Artificial
  mutated myrosinase
tttacaccactctaattttcacatatggagtcaccactcaccttatatttcgtcctgtaaagatcgacgaccgtggcatgagcaagaagctggttatgtgc

SEQ ID NO: 351 - DNA, 101 bp, Artificial
  mutated myrosinase
ttacaccactctaattttcacatatggagtcaccactcaccttatatttgatcctgtaaagatcgacgaccgtggcatgagcaagaagctggttatgtgca

SEQ ID NO: 352 - DNA, 101 bp, Artificial
  mutated myrosinase
ttacaccactctaattttcacatatggagtcaccactcaccttatatttgctcctgtaaagatcgacgaccgtggcatgagcaagaagctggttatgtgca

SEQ ID NO: 353 - DNA, 101 bp, Artificial
  mutated myrosinase
tatggagtcaccactcaccttatatttggtcctgtaaagatcgacgaccgcggcatgagcaagaagctggttatgtgcaacgatgtagggttctgttgaag

SEQ ID NO: 354 - DNA, 101 bp, Artificial
  mutated myrosinase
cacagacaagatttcaaagactatgcggatctatgtttcaaagaatttggcggaaaggtaaagcactggatcacgatcaaccagctattcacagtgcctac

SEQ ID NO: 355 - DNA, 101 bp, Artificial
  mutated myrosinase
tttcaaagactatgcggatctatgtttcaaagaatttggtggaaaggtaacgcactggatcacgatcaaccagctattcacagtgcctacgagaggctatg

SEQ ID NO: 356 - DNA, 101 bp, Artificial
  mutated myrosinase
tctatgtttcaaagaatttggtggaaaggtaaagcactggatcacgatcacccagctattcacagtgcctacgagaggctatgcactcggaacagatgcac

SEQ ID NO: 357 - DNA, 101 bp, Artificial
  mutated myrosinase
gaagctggttatgtgcaactatataaggttctgttgaagaatttccgccgaaacatctctcatcaaccttcggagaacatcgaccgggtgcatctgttccg

SEQ ID NO: 358 - DNA, 101 bp, Artificial
  mutated myrosinase
tataaggttctgttgaagaatttccgccgtaacatctctcatcaaccttctgagaacatcgaccgggtgcatctgttccgattgcatagcctctcgtaggc

SEQ ID NO: 359 - DNA, 101 bp, Artificial
  mutated myrosinase
tgttccgattgcatagcctctcgtaggcactgtgtacagctggttaatcgggatccagttcttcacctttccaccaaattccttgaaacatagatccgcat

SEQ ID NO: 360 - DNA, 101 bp, Artificial
  mutated myrosinase
aatcagatatgttagatttgcaccaccttaatatggagagaccactcaccatatatttggtcctgtaaagatcgacgaccgtggcatgagcaagaagctgg

SEQ ID NO: 361 - DNA, 101 bp, Artificial
  mutated myrosinase
gcaccaccttaatatggagagaccactcaccttatatttggtcctgtaaatcgtggcatgagcaagaagctggttatgtgcaacgatgtagggttctgttg

SEQ ID NO: 362 - DNA, 101 bp, Artificial; identical to SEQ ID NO: 157
  mutated myrosinase

SEQ ID NO: 363 - DNA, 102 bp, Artificial
  mutated myrosinase
caccaccttaatatggagagaccactcaccttatatttggtcctgtaaaggtcgtggcatgagcaagaagctggttatgtgcaacgatgtagggttctgttg

SEQ ID NO: 364 - DNA, 102 bp, Artificial
  mutated myrosinase
caccaccttaatatggagagaccactcaccttatatttggtcctgtaaagcttggcatgagcaagaagctggttatgtgcaacgatgtagggttctgttgaa

SEQ ID NO: 365 - DNA, 103 bp, Artificial
  mutated myrosinase
caccaccttaatatggagagaccactcaccttatatttggtcctgtaaagcgaggcatgagcaagaagctggttatgtgcaacgatgtagggttctgttgaag

SEQ ID NO: 366 - DNA, 103 bp, Artificial
  mutated myrosinase
caccaccttaatatggagagaccactcaccttatatttggtcctgtaaagcgcggcatgagcaagaagctggttatgtgcaacgatgtagggttctgttgaag

SEQ ID NO: 367 - DNA, 101 bp, Artificial
  mutated myrosinase
accactcaccttatatttggtcctgtaaagatcgacgaccgtggcatgagaaagaagctggttatgtgcaacgatgtagggttctgttgaagaatttccac

SEQ ID NO: 368 - DNA, 101 bp, Artificial; identical to SEQ ID NO: 158
  mutated myrosinase

SEQ ID NO: 369 - DNA, 103 bp, Artificial
  mutated myrosinase
atctgttccgaccgcatagcctctcgtagggactgtgtatagctggttgagcgttgaaacatagatccgcgtagtctttgaaatcttgtctgtgcatattata

SEQ ID NO: 370 - DNA, 101 bp, Artificial
  mutated myrosinase
ctgttccgaccgcatagcctctcgtagggactgtgtatagctggttgatcgttccaccaaattctttgaaacatagatccgcgtagtctttgaaatcttgt

SEQ ID NO: 371 - DNA, 101 bp, Artificial
  mutated myrosinase
ctgttccgaccgcatagcctctcgtagggactgtgtatagctggttgatcgttgaaacatagatccgcgtagtctttgaaatcttgtctgtgcatattata

SEQ ID NO: 372 - DNA, 101 bp, Artificial; identical to SEQ ID NO: 159
  mutated myrosinase

SEQ ID NO: 373 - DNA, 114 bp, Artificial
  mutated myrosinase
gttccgaccgcatagcctctcgtagggactgtgtatagctggttgatcgtctttacctttccaacaaattctttgaaacatagatccgcgtagtctttgaaatcttgtctgtgc

SEQ ID NO: 374 - DNA, 119 bp, Artificial
  mutated myrosinase
gttccgaccgcatagcctctcgtagggactgtgtatagctggttgatcgtctttacctttccaccaaagtctttgaaacatagatccgcgtagtctttgaaatcttgtctgtgcatatt

SEQ ID NO: 375 - DNA, 110 bp, Artificial
  mutated myrosinase
gttccgaccgcatagcctctcgtagggactgtgtatagctggttgatcgttccaccaaagtctttgaaacatagatccgcgtagtctttgaaatcttgtctgtgcatatt

SEQ ID NO: 376 - DNA, 121 bp, Artificial
  mutated myrosinase
atcttagattacactacaccatctttatcacgtattgagacaactcacctcgtatttggtcctgtaaagatcgtggcatgagcaagaagctggttatgtgcaacgatgtagggttctgttg

SEQ ID NO: 377 - DNA, 121 bp, Artificial
  mutated myrosinase
atcttagattacactacaccatctttatcacgtattgagacaactcacctggtatttggtcctgtaaagatcgtggcatgagcaagaagctggttatgtgcaacgatgtagggttctgttg

SEQ ID NO: 378 - DNA, 114 bp, Artificial
  mutated myrosinase
attacactacaccatctttatcacgtattgagacaactcaccttgtattttgtcctgtaaagatcgtggcatgagcaagaagctggttatgtgcaacgatgtagggttctgttg

SEQ ID NO: 379 - DNA, 101 bp, Artificial; identical to SEQ ID NO: 160
  mutated myrosinase

SEQ ID NO: 380 - DNA, 102 bp, Artificial
  mutated myrosinase
tttatcacgtattgagacaactcaccttgtatttggtcctgtaaagatcgtcgcatgagcaagaagctggttatgtgcaacgatgtagggttctgttgaaga

SEQ ID NO: 381 - DNA, 103 bp, Artificial
  mutated myrosinase
tttatcacgtattgagacaactcaccttgtatttggtcctgtaaagatcgtgtcatgagcaagaagctggttatgtgcaacgatgtagggttctgttgaagaa

SEQ ID NO: 382 - DNA, 126 bp, Artificial
  mutated myrosinase
gaggctatgcgatcggaacagatgcacccggtcgatgttctcctatggttaccgatctttacaggaccaaatatacggtgagtggcctccatatgtgaaaaggtggtctaaatctaacatatccga

SEQ ID NO: 383 - DNA, 126 bp, Artificial
  mutated myrosinase
gaggctatgcgatcggaacagatgcacccggtcgatgttctcctatggttaccgatctttacaggaccaaatatagggtgagtggcctccatatgtgaaaaggtggtctaaatctaacatatccga

SEQ ID NO: 384 - DNA, 102 bp, Artificial; identical to SEQ ID NO: 161
  mutated myrosinase

SEQ ID NO: 385 - DNA, 176 bp, Artificial
  mutated myrosinase
ggctatgcgatcggaacagatgcacccggtcgatgttctcctatggttgagaccacaggtgttacggcggaaattcttcaacagaaccctacatcgttgcacataaccagcttcttgctcatgccaaccaaatataaggtgagtggcctccatatgtgaaaaggtggtctaaatct

SEQ ID NO: 386 - DNA, 171 bp, Artificial
  mutated myrosinase
tgcgatcggaacagatgcacccggtcgatgttctcctatggttgataccacaggtgttacggcggaaattcttcaacagaacactacatcgttgcacataaccagcttcttgctcatgccaaccaaatataaggtgagtggcctccatatgtgaaaaggtggtctaaatct

SEQ ID NO: 387 - DNA, 171 bp, Artificial; identical to SEQ ID NO: 162
  mutated myrosinase

SEQ ID NO: 388 - DNA, 119 bp, Artificial
  mutated myrosinase
attaatatgcacagacaagatttcaaagattatgccgatctatgtttcaacgaatttggtggaaaggtagatcacgatcaaccagctatacacagtccctacgagaggctatgcagtcg

SEQ ID NO: 389 - DNA, 101 bp, Artificial; identical to SEQ ID NO: 163
  mutated myrosinase

SEQ ID NO: 390 - DNA, 101 bp, Artificial; identical to SEQ ID NO: 164
  mutated myrosinase

SEQ ID NO: 391 - DNA, 101 bp, Artificial
  mutated myrosinase
ccagcttcttgctcatgccacggtcgtcgatctttacaggaccaaatatagggtgaatgctgtctccatatgtgaaaattaaggtggtgtctaacatatct

SEQ ID NO: 392 - DNA, 101 bp, Artificial; identical to SEQ ID NO: 165
  mutated myrosinase

SEQ ID NO: 393 - DNA, 108 bp, Artificial
  mutated myrosinase
gcatctgttccgagtgcatagcctctcgtaggcactgtgtatagctggttctttgaatcatagatccgcgtaatctttgaaatcttggctgtgcatattagtatagaa

SEQ ID NO: 394 - DNA, 109 bp, Artificial
  mutated myrosinase
ctaattttcacatatggagtcaccactcaccttatatttggtcctgtaaatatcgacgcggcatgagcaagaagctggttatgtgcaacgatgtagggttctgttgaag

SEQ ID NO: 395 - DNA, 101 bp, Artificial; identical to SEQ ID NO: 166
  mutated myrosinase

SEQ ID NO: 396 - DNA, 112 bp, Artificial
  mutated myrosinase
tgctttactgaaagaatgattatatattaatatgcacagacaagatttcacagactatgcgggcctacgagaggctatgcactcggaacagatgcacccggtagatgttctc

SEQ ID NO: 397 - DNA, 101 bp, Artificial; identical to SEQ ID NO: 167
  mutated myrosinase

SEQ ID NO: 398 - DNA, 103 bp, Artificial
  mutated myrosinase
agaatgattatatattaatatgcacagacaagatttcaaagactatgcgggcatacgagaggctatgcactcggaacagatgcacccggtagatgttctccta

SEQ ID NO: 399 - DNA, 101 bp, Artificial
  mutated myrosinase
cgcagcatgagcaagaagctggttatgtgcaactatataaggttctgttgcagaatttccgccgtaacatctctcatcaaccttcggagaacatcgaccgg

SEQ ID NO: 400 - DNA, 119 bp, Artificial
  mutated myrosinase
agcatgagcaagaagctggttatgtgcaactatataaggttctgttgaagcatttccgccgtaacatctcttcggagaacatcgaccgggtgcatctgttccgattgcatagcctctcg

SEQ ID NO: 401 - DNA, 101 bp, Artificial; identical to SEQ ID NO: 170
  mutated myrosinase

SEQ ID NO: 402 - DNA, 126 bp, Artificial
  mutated myrosinase
tgttccgattgcatagcctctcgtaggcactgtgtacagctggttaatcgatcttcaccttgccaccaaattcctggaaacatagatccgcataatctctaaagtcatctctgtgcatagcataga

SEQ ID NO: 403 - DNA, 112 bp, Artificial
  mutated myrosinase
tgttccgattgcatagcctctcgtaggcactgtgtacagctggttaatcgatcttcaccttgccaccaaattccttgaaacatagatccgcataatctctaaagtcatctct

SEQ ID NO: 404 - DNA, 126 bp, Artificial
  mutated myrosinase
tgttccgattgcatagcctctcgtaggcactgtgtacagctggttaatcgatcttcacctttccaccaaattcctggaaacatagatccgcataatctctaaagtcatctctgtgcatagcataga

SEQ ID NO: 405 - DNA, 101 bp, Artificial; identical to SEQ ID NO: 172
  mutated myrosinase

SEQ ID NO: 406 - DNA, 104 bp, Artificial
  mutated myrosinase
gttgaagaatttccggcgtaacatgtaggatcaacctttggagaacatcggccaatcctaatccatagcctctcgtaggcactgagtagagctggttgattgtg

SEQ ID NO: 407 - DNA, 101 bp, Artificial; identical to SEQ ID NO: 174
  mutated myrosinase

SEQ ID NO: 408 - DNA, 101 bp, Artificial; identical to SEQ ID NO: 175
  mutated myrosinase

SEQ ID NO: 409 - DNA, 119 bp, Artificial
  mutated myrosinase
gatcctaatccatagcctctcgtaggcactgagtagagctggttgattgtactttgtcaccaaattctgcgaaacatagatccgcgtaatctctgaaatcatctctgcgagtattatag

SEQ ID NO: 410 - DNA, 109 bp, Artificial
  mutated myrosinase
gatcctaatccatagcctctcgtaggcactgagtagagctggttgattgtactttgtctccaaattcttcgaaacatagatccgcgtaatctctgaaatcatctctgcg

SEQ ID NO: 411 - DNA, 101 bp, Artificial; identical to SEQ ID NO: 157
  mutated myrosinase

SEQ ID NO: 412 - DNA, 101 bp, Artificial; identical to SEQ ID NO: 158
  mutated myrosinase

SEQ ID NO: 413 - DNA, 101 bp, Artificial; identical to SEQ ID NO: 159
  mutated myrosinase

SEQ ID NO: 414 - DNA, 105 bp, Artificial
  mutated myrosinase
gttccgaccgcatagcctctcgtagggactgtgtatagctggttgatcgtctttccctttccaccaaattctttgaaacatagatccgcgtagtctttgaaatct

SEQ ID NO: 415 - DNA, 105 bp, Artificial
  mutated myrosinase
gttccgaccgcatagcctctcgtagggactgtgtatagctggttgatcgtcttttcctttccaccaaattctttgaaacatagatccgcgtagtctttgaaatct

SEQ ID NO: 416 - DNA, 101 bp, Artificial; identical to SEQ ID NO: 160
  mutated myrosinase

SEQ ID NO: 417 - DNA, 115 bp, Artificial
  mutated myrosinase
acagtgcctacaagaggctatgcgatcggaacagatgcacccggtcgatggtctcctatggttaccgatctttacaggaccaaatataaggtgagtggcctccatatgtgaaaag

SEQ ID NO: 418 - DNA, 117 bp, Artificial
  mutated myrosinase
gaggctatgcgatcggaacagatgcacccggtcgatgttctcctatggttaccgatctttacaggaacaaatataaggtgagtggcctccatatgtgaaaaggtggtctaaatctaa

SEQ ID NO: 419 - DNA, 102 bp, Artificial; identical to SEQ ID NO: 161
  mutated myrosinase

SEQ ID NO: 420 - DNA, 171 bp, Artificial; identical to SEQ ID NO: 162
  mutated myrosinase

SEQ ID NO: 421 - DNA, 120 bp, Artificial
  mutated myrosinase
gcattactgaaatgattctatattaatatgcacagacaagatttcaaagactacgcggatctatgtttcaacgatcaaccagctatacacagtccctacgagaggctatgcagtcggaac

SEQ ID NO: 422 - DNA, 110 bp, Artificial
  mutated myrosinase
cacagacaagatttcaaagattatgccgatctatgtttcaaagaatttgggggaaaggtagatcacgatcaaccagctatacacagtccctacgagaggctatgcagtcg

SEQ ID NO: 423 - DNA, 101 bp, Artificial; identical to SEQ ID NO: 163
  mutated myrosinase

SEQ ID NO: 424 - DNA, 101 bp, Artificial; identical to SEQ ID NO: 164
  mutated myrosinase

SEQ ID NO: 425 - DNA, 200 bp, Artificial
  mutated myrosinase
caacagaaccctatatcgttgcacataaccagcttcttgctcatgccacgatctttacaggaccaaatataaggtgaatgctgtctccatatgtgaaaattaaggtggtgtctaacatatctgattctaatgtaaatatcacgtgaccagcagttccaaaaagggaagattggacctgtgatgataacaagatggtttct

SEQ ID NO: 426 - DNA, 201 bp, Artificial
  mutated myrosinase
caacagaaccctatatcgttgcacataaccagcttcttgctcatgccacgatctttacaggaccaaatataaggtgaatgctgtctccatatgtgaaaattaaggtggtgtctaacatatctgattctaatgtaaatatcacgtgaccaacaagggaagattggacctgtgatgataacaagatggtttcttccatttgat

SEQ ID NO: 427 - DNA, 206 bp, Artificial
  mutated myrosinase
caacagaaccctatatcgttgcacataaccagcttcttgctcatgccacgatctttacaggaccaaatataaggtgaatgctgtctccatatgtgaaaattaaggtggtgtctaacatatctgattctaatgtaaatatcacgtgaccaacagtttcaaaaagggaagattggacctgtgatgataacaagatggtttcttccatt

SEQ ID NO: 428 - DNA, 221 bp, Artificial
  mutated myrosinase
caacagaaccctatatcgttgcacataaccagcttcttgctcatgccacgatctttacaggaccaaatataaggtgaatgctgtctccatatgtgaaaattaaggtggtgtctaacatatctgattctaatgtaaatatcacgtgaccaacagttccaaggagggaagatcggacctgtgatgataacaagatggtttcttccatttgatgagtctgatcc

SEQ ID NO: 429 - DNA, 212 bp, Artificial
  mutated myrosinase
caacagaaccctatatcgttgcacataaccagcttcttgctcatgccacgatctttacaggaccaaatataaggtgaatgctgtctccatatgtgaaaattaaggtggtgtctaacatatctgattctaatgtaaatatcacgtgaccaacagttccaaaacgggaagattggacctgtgatgataacaagatggtttcttccatttgatga

SEQ ID NO: 430 - DNA, 150 bp, Artificial
  mutated myrosinase
caacagaaccctatatcgttgcacataaccagcttcttgctcatgccacgatctttacaggaccaaatataaggtgaatgctgtctccatatgtgaaaagtaaggtggtgtctaacatatctgattctaatgtaaatatcacgtgaccaa

SEQ ID NO: 431 - DNA, 101 bp, Artificial; identical to SEQ ID NO: 165
  mutated myrosinase

SEQ ID NO: 432 - DNA, 101 bp, Artificial; identical to SEQ ID NO: 166
  mutated myrosinase

SEQ ID NO: 433 - DNA, 118 bp, Artificial
  mutated myrosinase
attacatgctttactgaaagaatgattatatattaatatgcacagacaagctttcaaagactatgcgggcctacgagaggctatgcactcggaacagatgcacccggtagatgttctc

SEQ ID NO: 434 - DNA, 101 bp, Artificial; identical to SEQ ID NO: 167
  mutated myrosinase

SEQ ID NO: 435 - DNA, 108 bp, Artificial
  mutated myrosinase
gaagctggttatgtgcaactatataaggttctgttgaagaatttccgccgaaacatctcttcggagaacatcgaccgggtgcatctgttccgattgcatagcctctcg

SEQ ID NO: 436 - DNA, 101 bp, Artificial; identical to SEQ ID NO: 170
  mutated myrosinase

SEQ ID NO: 437 - DNA, 101 bp, Artificial; identical to SEQ ID NO: 172
  mutated myrosinase

SEQ ID NO: 438 - DNA, 107 bp, Artificial
  mutated myrosinase
tgttccgattgcatagcctctcgtaggcactgtgtacagctggttaatcgatcttcccctttccaccaaattccttgaaacatagatccgcataatctctaaagtca

SEQ ID NO: 439 - DNA, 101 bp, Artificial; identical to SEQ ID NO: 174
  mutated myrosinase

SEQ ID NO: 440 - DNA, 101 bp, Artificial; identical to SEQ ID NO: 175
  mutated myrosinase

SEQ ID NO: 441 - DNA, 111 bp, Artificial
  mutated myrosinase
tgttagatttgcaccaccttaatatggagagaccactcaccttatatttgttcctgtaaagcgtggcatgagcaagaagctggttatgtgcaacgatgtagggttctgttg

SEQ ID NO: 442 - DNA, 101 bp, Artificial; identical to SEQ ID NO: 361
  mutated myrosinase

SEQ ID NO: 443 - DNA, 101 bp, Artificial; identical to SEQ ID NO: 157
  mutated myrosinase

SEQ ID NO: 444 - DNA, 102 bp, Artificial; identical to SEQ ID NO: 363
  mutated myrosinase

SEQ ID NO: 445 - DNA, 101 bp, Artificial; identical to SEQ ID NO: 158
  mutated myrosinase

SEQ ID NO: 446 - DNA, 103 bp, Artificial; identical to SEQ ID NO: 369
  mutated myrosinase

SEQ ID NO: 447 - DNA, 101 bp, Artificial; identical to SEQ ID NO: 370
  mutated myrosinase

SEQ ID NO: 448 - DNA, 101 bp, Artificial; identical to SEQ ID NO: 371
  mutated myrosinase

SEQ ID NO: 449 - DNA, 101 bp, Artificial; identical to SEQ ID NO: 159
  mutated myrosinase

SEQ ID NO: 450 - DNA, 110 bp, Artificial; identical to SEQ ID NO: 375
  mutated myrosinase

SEQ ID NO: 451 - DNA, 114 bp, Artificial; identical to SEQ ID NO: 373
  mutated myrosinase

SEQ ID NO: 452 - DNA, 119 bp, Artificial; identical to SEQ ID NO: 374
  mutated myrosinase

SEQ ID NO: 453 - DNA, 121 bp, Artificial; identical to SEQ ID NO: 376
  mutated myrosinase

SEQ ID NO: 454 - DNA, 121 bp, Artificial; identical to SEQ ID NO: 377
  mutated myrosinase

SEQ ID NO: 455 - DNA, 101 bp, Artificial; identical to SEQ ID NO: 160
  mutated myrosinase

SEQ ID NO: 456 - DNA, 118 bp, Artificial
  mutated myrosinase
tttatcacgtattgagacaactcaccttgtatttggtcctgtaaagatcgtggcatgagcaagaagccggttatgtgcaacgatgtagggttctgttgaagaatttccaccgtaacac

SEQ ID NO: 457 - DNA, 203 bp, Artificial
  mutated myrosinase
aaccagctatacacagtgcctacaagaggctatgcgatcggaacagatgcgcccggtcgatgttctcctatggttgataccacaggtgttacggcggaaattcttcaacagaaccctacatcgttgcacataaccagcttcttgctcatgccaaccaaatataaggtgagtggcctccatatgtgaaaaggtggtctaaatct

SEQ ID NO: 458 - DNA, 202 bp, Artificial
  mutated myrosinase
accagctatacacagtgcctacaagaggctatgcgatcggaacagatgcaaccggtcgatgttctcctatggttgataccacaggtgttacggcggaaattcttcaacagaaccctacatcgttgcacataaccagcttcttgctcatgccaaccaaatataaggtgagtggcctccatatgtgaaaaggtggtctaaatct

SEQ ID NO: 459 - DNA, 176 bp, Artificial; identical to SEQ ID NO: 385
  mutated myrosinase

SEQ ID NO: 460 - DNA, 182 bp, Artificial
  mutated myrosinase
tgcgatcggaacagatgcacccggtcgatgttctcctatggttgataccacaggtgttacggcggaaattcttcaacagaacactacatcgttgcacataaccagcttcttgctcatgccaaccaaatatacggtgagtggcctccatatgtgaaaaggtggtctaaatctaacatatccga

SEQ ID NO: 461 - DNA, 182 bp, Artificial
  mutated myrosinase
tgcgatcggaacagatgcacccggtcgatgttctcctatggttgataccacaggtgttacggcggaaattcttcaacagaacactacatcgttgcacataaccagcttcttgctcatgccaaccaaatatagggtgagtggcctccatatgtgaaaaggtggtctaaatctaacatatccga

SEQ ID NO: 462 - DNA, 171 bp, Artificial; identical to SEQ ID NO: 386
  mutated myrosinase

SEQ ID NO: 463 - DNA, 182 bp, Artificial
  mutated myrosinase
tgcgatcggaacagatgcacccggtcgatgttctcctatggttgataccacaggtgttacggcggaaattcttcaacagaaccctacatcgttgcacataaccagcttcttgctcatgccaaccaaatatacggtgagtggcctccatatgtgaaaaggtggtctaaatctaacatatccga

SEQ ID NO: 464 - DNA, 182 bp, Artificial
  mutated myrosinase
tgcgatcggaacagatgcacccggtcgatgttctcctatggttgataccacaggtgttacggcggaaattcttcaacagaaccctacatcgttgcacataaccagcttcttgctcatgccaaccaaatatagggtgagtggcctccatatgtgaaaaggtggtctaaatctaacatatccga

SEQ ID NO: 465 - DNA, 171 bp, Artificial; identical to SEQ ID NO: 162
  mutated myrosinase

SEQ ID NO: 466 - DNA, 120 bp, Artificial; identical to SEQ ID NO: 421
  mutated myrosinase

SEQ ID NO: 467 - DNA, 132 bp, Artificial
  mutated myrosinase
gaaatgattctatattaatatgcacagacaagatttcaaagattatgccgctctatgtttcaaagaatttggtggaaaggtagatcacgatcaaccagctatacacagtccctacgagaggctatgcagtcg

SEQ ID NO: 468 - DNA, 126 bp, Artificial
  mutated myrosinase
attctatattaatatgcacagacaagatttcaaagattatgccgatctatttttcaaagaatttggtggaaaggtagatcacgatcaaccagctatacacagtccctacgagaggctatgcagtcg

SEQ ID NO: 469 - DNA, 119 bp, Artificial; identical to SEQ ID NO: 388
  mutated myrosinase

SEQ ID NO: 470 - DNA, 102 bp, Artificial
  mutated myrosinase
agatttcaaagattatgccgatctatgtttcaaagaatttggtggaaaggaagatcacgatcaaccagctatacacagtccctacgagaggctatgcagtcg

SEQ ID NO: 471 - DNA, 102 bp, Artificial
  mutated myrosinase
agatttcaaagattatgccgatctatgtttcaaagaatttggtggaaaggcagatcacgatcaaccagctatacacagtccctacgagaggctatgcagtcg

SEQ ID NO: 472 - DNA, 101 bp, Artificial; identical to SEQ ID NO: 163
  mutated myrosinase

SEQ ID NO: 473 - DNA, 125 bp, Artificial
  mutated myrosinase
agcacaggtgttacggcggaaattcttcaacagaaccctatatcgttgcaaataaccagcttcttgctcatgccacgatctttacaggaccaaatataaggtgaatgctgtctccatatgtgaaa

SEQ ID NO: 474 - DNA, 101 bp, Artificial; identical to SEQ ID NO: 164
  mutated myrosinase

SEQ ID NO: 475 - DNA, 108 bp, Artificial
  mutated myrosinase
caacagaaccctatatcgttgcacataaccagcttcttgctcatgccacgatctttaaaggaccaaatataaggtgaatgctgtctccatatgtgaaaattaaggtgg

SEQ ID NO: 476 - DNA, 115 bp, Artificial
  mutated myrosinase
aagaacatcgaccgggtgcatctgttccgagtgcatagcctctcgtaggcgctgtgtatagctggttctttgaaacatagatccgcgtaatctttgaaatcttggctgtgcatat

SEQ ID NO: 477 - DNA, 101 bp, Artificial; identical to SEQ ID NO: 165
  mutated myrosinase

SEQ ID NO: 478 - DNA, 108 bp, Artificial; identical to SEQ ID NO: 393
  mutated myrosinase

SEQ ID NO: 479 - DNA, 129 bp, Artificial
  mutated myrosinase
ctaattttcacatatggagtcaccactcaccttatatttggtcctgtaaatatcgacgcggcatgagcaagaagctgggtatgtgcaacgatgtagggttctgttgaagaatttccgccgtaacacctg

SEQ ID NO: 480 - DNA, 109 bp, Artificial; identical to SEQ ID NO: 394
  mutated myrosinase

SEQ ID NO: 481 - DNA, 120 bp, Artificial
  mutated myrosinase
cacatatggagtcaccactcaccttatatttggtcctgtaaagatcgacgcggcatgagcaagaagctgtttatgtgcaacgatgtagggttctgttgaagaatttccgccgtaacacct

SEQ ID NO: 482 - DNA, 121 bp, Artificial
  mutated myrosinase
cacatatggagtcaccactcaccttatatttggtcctgtaaagatcgacgcggcatgagcaagaagctgggtatgtgcaacgatgtagggttctgttgaagaatttccgccgtaacacctg

SEQ ID NO: 483 - DNA, 101 bp, Artificial; identical to SEQ ID NO: 166
  mutated myrosinase

SEQ ID NO: 484 - DNA, 161 bp, Artificial
  mutated myrosinase
ttattaataaaaacaagaagaagaagaagaaggttttgtcttaattacattctttactgaaagactgattatatattaatatgcacagacaagatttcacagactatgcgggcctacgagaggctatgcactcggaacagatgcacccggtagatgttctc

SEQ ID NO: 485 - DNA, 192 bp, Artificial
  mutated myrosinase
ttattaataaaaacaagaagaagaagaagaaggttttgtcttaattacattctttactgaaagactgattatatattaatatgcacagacaagatttcacagactatgcggatctatgtttcaaagaatttggtggaaaggtacgatcaaccagctattcacagtgcctacgagaggctatgcactcggaac

SEQ ID NO: 486 - DNA, 161 bp, Artificial
  mutated myrosinase
ttattaataaaaacaagaagaagaagaagaaggttttgtcttaattacattctttactgaaagaatgattatatattaatatgcacagacaagatttcacagactatgcgggcctacgagaggctatgcactcggaacagatgcacccggtagatgttctc

SEQ ID NO: 487 - DNA, 192 bp, Artificial
  mutated myrosinase
ttattaataaaaacaagaagaagaagaagaaggttttgtcttaattacattctttactgaaagaatgattatatattaatatgcacagacaagatttcacagactatgcggatctatgtttcaaagaatttggtggaaaggtacgatcaaccagctattcacagtgcctacgagaggctatgcactcggaac

SEQ ID NO: 488 - DNA, 161 bp, Artificial
  mutated myrosinase
ttattaataaaaacaagaagaagaagaagaaggttttgtcttaattacattctttactgaaagaatgattatatattaatatgcacagacaagatttcaaagactatgcgggcctacgagaggctatgcactcggaacagatgcacccggtagatgttctc

SEQ ID NO: 489 - DNA, 192 bp, Artificial
  mutated myrosinase
ttattaataaaaacaagaagaagaagaagaaggttttgtcttaattacattctttactgaaagaatgattatatattaatatgcacagacaagatttcaaagactatgcggatctatgtttcaaagaatttggtggaaaggtacgatcaaccagctattcacagtgcctacgagaggctatgcactcggaac

SEQ ID NO: 490 - DNA, 133 bp, Artificial
  mutated myrosinase
gaaggttttgtcttaattacatgctttactgaaagaatgattatatattactatgcacagacaagatttcaaagactatgcgggcctacgagaggctatgcactcggaacagatgcacccggtagatgttctc

SEQ ID NO: 491 - DNA, 164 bp, Artificial
  mutated myrosinase
gaaggttttgtcttaattacatgctttactgaaagaatgattatatattactatgcacagacaagatttcaaagactatgcggatctatgtttcaaagaatttggtggaaaggtacgatcaaccagctattcacagtgcctacgagaggctatgcactcggaac

SEQ ID NO: 492 - DNA, 112 bp, Artificial; identical to SEQ ID NO: 396
  mutated myrosinase

SEQ ID NO: 493 - DNA, 143 bp, Artificial
  mutated myrosinase
tgctttactgaaagaatgattatatattaatatgcacagacaagatttcacagactatgcggatctatgtttcaaagaatttggtggaaaggtacgatcaaccagctattcacagtgcctacgagaggctatgcactcggaac

SEQ ID NO: 494 - DNA, 143 bp, Artificial
  mutated myrosinase
tgctttactgaaagaatgattatatattaatatgcacagacaagatttcacagactattcggatctatgtttcaaagaatttggtggaaaggtacgatcaaccagctattcacagtgcctacgagaggctatgcactcggaac

SEQ ID NO: 495 - DNA, 101 bp, Artificial; identical to SEQ ID NO: 167
  mutated myrosinase

SEQ ID NO: 496 - DNA, 103 bp, Artificial; identical to SEQ ID NO: 398
  mutated myrosinase

SEQ ID NO: 497 - DNA, 101 bp, Artificial; identical to SEQ ID NO: 168
  mutated myrosinase

SEQ ID NO: 498 - DNA, 134 bp, Artificial
  mutated myrosinase
aacatcgaccgccgcagcatgagcaagaagctggttatgtgcaactatatgaggttctgttgaagaatttccgccgtaacatctcttcggagaacatcgaccgggtgcatctgttccgattgcatagcctctcg

SEQ ID NO: 499 - DNA, 130 bp, Artificial
  mutated myrosinase
tcgaccgccgcagcatgagcaagaagctggttatgtgcaactatataaggctctgttgaagaatttccgccgtaacatctcttcggagaacatcgaccgggtgcatctgttccgattgcatagcctctcg

SEQ ID NO: 500 - DNA, 125 bp, Artificial
  mutated myrosinase
cgccgcagcatgagcaagaagctggttatgtgcaactatataaggttctgctgaagaatttccgccgtaacatctcttcggagaacatcgaccgggtgcatctgttccgattgcatagcctctcg

SEQ ID NO: 501 - DNA, 119 bp, Artificial; identical to SEQ ID NO: 400
  mutated myrosinase

SEQ ID NO: 502 - DNA, 108 bp, Artificial
  mutated myrosinase
gaagctggttatgtgcaactatataaggttctgttgaagaatttccgccgcaacatctcttcggagaacatcgaccgggtgcatctgttccgattgcatagcctctcg

SEQ ID NO: 503 - DNA, 101 bp, Artificial; identical to SEQ ID NO: 170
  mutated myrosinase

SEQ ID NO: 504 - DNA, 126 bp, Artificial; identical to SEQ ID NO: 402
  mutated myrosinase

SEQ ID NO: 505 - DNA, 112 bp, Artificial; identical to SEQ ID NO: 403
  mutated myrosinase

SEQ ID NO: 506 - DNA, 115 bp, Artificial
  mutated myrosinase
tgttccgattgcatagcctctcgtaggcactgtgtacagctggttaatcgatcttcacctttccgccaaattccttgaaacatagatccgcataatctctaaagtcatctctgtg

SEQ ID NO: 507 - DNA, 126 bp, Artificial
  mutated myrosinase
tgttccgattgcatagcctctcgtaggcactgtgtacagctggttaatcgatcttcacctttccaccaaatgcctggaaacatagatccgcataatctctaaagtcatctctgtgcatagcataga

SEQ ID NO: 508 - DNA, 122 bp, Artificial
  mutated myrosinase
tgttccgattgcatagcctctcgtaggcactgtgtacagctggttaatcgatcttcacctttccaccaaatgccttgaaacatagatccgcataatctctaaagtcatctctgtgcatagca

SEQ ID NO: 509 - DNA, 125 bp, Artificial
  mutated myrosinase
tgttccgattgcatagcctctcgtaggcactgtgtacagctggttaatcgatcttcacctttccaccaaattccgtgaaacatagatccgcataatctctaaagtcatctctgtgcatagcatag

SEQ ID NO: 510 - DNA, 126 bp, Artificial; identical to SEQ ID NO: 404
  mutated myrosinase

SEQ ID NO: 511 - DNA, 101 bp, Artificial; identical to SEQ ID NO: 172
  mutated myrosinase

SEQ ID NO: 512 - DNA, 101 bp, Artificial; identical to SEQ ID NO: 173
  mutated myrosinase

SEQ ID NO: 513 - DNA, 101 bp, Artificial; identical to SEQ ID NO: 174
  mutated myrosinase

SEQ ID NO: 514 - DNA, 101 bp, Artificial; identical to SEQ ID NO: 175
  mutated myrosinase

SEQ ID NO: 515 - DNA, 119 bp, Artificial; identical to SEQ ID NO: 409
  mutated myrosinase

SEQ ID NO: 516 - DNA, 109 bp, Artificial; identical to SEQ ID NO: 410
  mutated myrosinase

SEQ ID NO: 517 - DNA, 101 bp, Artificial; identical to SEQ ID NO: 157
  mutated myrosinase

SEQ ID NO: 518 - DNA, 117 bp, Artificial
  mutated myrosinase
caccaccttaatatggagagaccactcaccttatatttggtcctgtaaagcgtggcatgagcaagacgctggttatgtgcaacgatgtagggttctgttgaagaatttccaccgtaa

SEQ ID NO: 519 - DNA, 101 bp, Artificial; identical to SEQ ID NO: 158
  mutated myrosinase

SEQ ID NO: 520 - DNA, 101 bp, Artificial; identical to SEQ ID NO: 159
  mutated myrosinase

SEQ ID NO: 521 - DNA, 105 bp, Artificial; identical to SEQ ID NO: 414
  mutated myrosinase

SEQ ID NO: 522 - DNA, 105 bp, Artificial; identical to SEQ ID NO: 415
  mutated myrosinase

SEQ ID NO: 523 - DNA, 101 bp, Artificial; identical to SEQ ID NO: 160
  mutated myrosinase

SEQ ID NO: 524 - DNA, 101 bp, Artificial
  mutated myrosinase
catagcctctcgtagggactgtgtatatctggttgatcgtgatccagtgcgttacctttccaccaaattctttgaaacatagatccgcgtaatctttgaaa

SEQ ID NO: 525 - DNA, 171 bp, Artificial
  mutated myrosinase
tgcgatcggaacagatgcacccggtcgatgttctcctatggttgataccacaggtgttacggcggaaattcttcaacagaaccctacatcgttgcacataaccagcttcttgatcatgccaaccaaatataaggtgagtggcctccatatgtgaaaaggtggtctaaatct

SEQ ID NO: 526 - DNA, 173 bp, Artificial
  mutated myrosinase
tgcgatcggaacagatgcacccggtcgatgttctcctatggttgataccacaggtgttacggcggaaattcttcaacagaaccctacatcgttgcacataaccagcttcttgctcatgccaaacaaatataaggtgagtggcctccatatgtgaaaaggtggtctaaatctaa

SEQ ID NO: 527 - DNA, 171 bp, Artificial; identical to SEQ ID NO: 162
  mutated myrosinase

SEQ ID NO: 528 - DNA, 110 bp, Artificial; identical to SEQ ID NO: 422
  mutated myrosinase

SEQ ID NO: 529 - DNA, 101 bp, Artificial; identical to SEQ ID NO: 163
  mutated myrosinase

SEQ ID NO: 530 - DNA, 101 bp, Artificial; identical to SEQ ID NO: 164
  mutated myrosinase

SEQ ID NO: 531 - DNA, 200 bp, Artificial; identical to SEQ ID NO: 425
  mutated myrosinase

SEQ ID NO: 532 - DNA, 201 bp, Artificial; identical to SEQ ID NO: 426
  mutated myrosinase

SEQ ID NO: 533 - DNA, 206 bp, Artificial; identical to SEQ ID NO: 427
  mutated myrosinase

SEQ ID NO: 534 - DNA, 221 bp, Artificial; identical to SEQ ID NO: 428
  mutated myrosinase

SEQ ID NO: 535 - DNA, 212 bp, Artificial; identical to SEQ ID NO: 429
  mutated myrosinase

SEQ ID NO: 536 - DNA, 150 bp, Artificial; identical to SEQ ID NO: 430
  mutated myrosinase

SEQ ID NO: 537 - DNA, 151 bp, Artificial
  mutated myrosinase
caacagaaccctatatcgttgcacataaccagcttcttgctcatgccacgatctttacaggaccaaatataaggtgaatgctgtctccatatgtgaaaatgaaggtggtgtctaacatatctgattctaatgtaaatatcacgtgaccaac

SEQ ID NO: 538 - DNA, 101 bp, Artificial; identical to SEQ ID NO: 165
  mutated myrosinase

SEQ ID NO: 539 - DNA, 101 bp, Artificial; identical to SEQ ID NO: 166
  mutated myrosinase

SEQ ID NO: 540 - DNA, 118 bp, Artificial; identical to SEQ ID NO: 433
  mutated myrosinase

SEQ ID NO: 541 - DNA, 149 bp, Artificial
  mutated myrosinase
attacatgctttactgaaagaatgattatatattaatatgcacagacaagctttcaaagactatgcggatctatgtttcaaagaatttggtggaaaggtacgatcaaccagctattcacagtgcctacgagaggctatgcactcggaac

SEQ ID NO: 542 - DNA, 101 bp, Artificial; identical to SEQ ID NO: 167
  mutated myrosinase

SEQ ID NO: 543 - DNA, 101 bp, Artificial; identical to SEQ ID NO: 168
  mutated myrosinase

SEQ ID NO: 544 - DNA, 108 bp, Artificial; identical to SEQ ID NO: 435
  mutated myrosinase

SEQ ID NO: 545 - DNA, 101 bp, Artificial; identical to SEQ ID NO: 170
  mutated myrosinase

SEQ ID NO: 546 - DNA, 101 bp, Artificial; identical to SEQ ID NO: 172
  mutated myrosinase

SEQ ID NO: 547 - DNA, 107 bp, Artificial; identical to SEQ ID NO: 438
  mutated myrosinase

SEQ ID NO: 548 - DNA, 101 bp, Artificial; identical to SEQ ID NO: 173
  mutated myrosinase

SEQ ID NO: 549 - DNA, 101 bp, Artificial; identical to SEQ ID NO: 174
  mutated myrosinase

SEQ ID NO: 550 - DNA, 101 bp, Artificial; identical to SEQ ID NO: 175
  mutated myrosinase

SEQ ID NO: 551 - DNA, 101 bp, Artificial; identical to SEQ ID NO: 148
  mutated myrosinase

SEQ ID NO: 552 - DNA, 101 bp, Artificial
  mutated myrosinase
gcaccaccttaatatggagagaccactcaccttatatttggtcctgtaaataaccataggagaacatcgaccgggtgcatctgttccgaccgcatagcctc

SEQ ID NO: 553 - DNA, 101 bp, Artificial; identical to SEQ ID NO: 149
  mutated myrosinase

SEQ ID NO: 554 - DNA, 101 bp, Artificial; identical to SEQ ID NO: 150
  mutated myrosinase

SEQ ID NO: 555 - DNA, 113 bp, Artificial
  mutated myrosinase
ttccgaccgcatagcctctcgtagggactgtgtatagctggttgatcgtgctttacctttcctccaaattctttgaaacatagatccgcgtagtctttgaaatcttgtctgtg

SEQ ID NO: 556 - DNA, 119 bp, Artificial
  mutated myrosinase
ttccgaccgcatagcctctcgtagggactgtgtatagctggttgatcgtgctttacctttccaccaaagtctttgaaacatagatccgcgtagtctttgaaatcttgtctgtgcatatt

SEQ ID NO: 557 - DNA, 102 bp, Artificial
  mutated myrosinase
ttccgaccgcatagcctctcgtagggactgtgtatagctggttgatcgtgcgttacctttccaccaaattctttgaaacatagatccgcgtagtctttgaaa

SEQ ID NO: 558 - DNA, 103 bp, Artificial
  mutated myrosinase
ttccgaccgcatagcctctcgtagggactgtgtatagctggttgatcgtgctgtacctttccaccaaattctttgaaacatagatccgcgtagtctttgaaat

SEQ ID NO: 559 - DNA, 115 bp, Artificial
  mutated myrosinase
agtgcctacaagaggctatgcgatcggaacagatgcacccggtcgatgttatcctatggttgattcaggtgttacggcggaaattcttcaacagaaccctacatcgttgcacata

SEQ ID NO: 560 - DNA, 101 bp, Artificial; identical to SEQ ID NO: 151
  mutated myrosinase

SEQ ID NO: 561 - DNA, 126 bp, Artificial
  mutated myrosinase
tcttcaacagaaccctacatcgttgcacataaccagcttcttgctcatgcatcgatctttacaggaccaaatatacggtgagtggcctccatatgtgaaaaggtggtctaaatctaacatatccga

SEQ ID NO: 562 - DNA, 126 bp, Artificial
  mutated myrosinase
tcttcaacagaaccctacatcgttgcacataaccagcttcttgctcatgcatcgatctttacaggaccaaatatagggtgagtggcctccatatgtgaaaaggtggtctaaatctaacatatccga

SEQ ID NO: 563 - DNA, 126 bp, Artificial
  mutated myrosinase
tcttcaacagaaccctacatcgttgcacataaccagcttcttgctcatgcatcgatctttacaggaccaaatatatggtgagtggcctccatatgtgaaaaggtggtctaaatctaacatatccga

SEQ ID NO: 564 - DNA, 101 bp, Artificial; identical to SEQ ID NO: 152
  mutated myrosinase

SEQ ID NO: 565 - DNA, 108 bp, Artificial
  mutated myrosinase
tcttcaacagaaccctacatcgttgcacataaccagcttcttgctcatgcatcgatcgttacaggaccaaatataaggtgagtggcctccatatgtgaaaaggtggtc

SEQ ID NO: 566 - DNA, 101 bp, Artificial; identical to SEQ ID NO: 224
  mutated myrosinase

SEQ ID NO: 567 - DNA, 127 bp, Artificial
  mutated myrosinase
acaaacctatatatactcaccttatattttgtcctgtaaacatcgaccgcttatataaggtgagtatagttgcacagacatgatggtgcggttcaagaaaccttcatactcatcttgcagtgtttga

SEQ ID NO: 568 - DNA, 129 bp, Artificial
  mutated myrosinase
acaaacctatatatactcaccttatattttgtcctgtaaacatcgaccgcttatataaggtgagtatagttgcacataaatgatggtgcggttcaagaaaccttcatactcatcttgcagtgtttgagg

SEQ ID NO: 569 - DNA, 123 bp, Artificial; identical to SEQ ID NO: 226
  mutated myrosinase

SEQ ID NO: 570 - DNA, 101 bp, Artificial; identical to SEQ ID NO: 155
  mutated myrosinase

SEQ ID NO: 571 - DNA, 101 bp, Artificial; identical to SEQ ID NO: 148
  mutated myrosinase

SEQ ID NO: 572 - DNA, 101 bp, Artificial; identical to SEQ ID NO: 149
  mutated myrosinase

SEQ ID NO: 573 - DNA, 101 bp, Artificial; identical to SEQ ID NO: 150
  mutated myrosinase

SEQ ID NO: 574 - DNA, 101 bp, Artificial; identical to SEQ ID NO: 151
  mutated myrosinase

SEQ ID NO: 575 - DNA, 114 bp, Artificial
  mutated myrosinase
ttacggcggaaattcttcaacagaaccctacatcgttgcacataaccagcgtcttgctcatgcatcgatctttacaggaccaaatataaggtgagtggcctccatatgtgaaaa

SEQ ID NO: 576 - DNA, 117 bp, Artificial
  mutated myrosinase
tcttcaacagaaccctacatcgttgcacataaccagcttcttgctcatgcatcgatctttacaggaacaaatataaggtgagtggcctccatatgtgaaaaggtggtctaaatctaa

SEQ ID NO: 577 - DNA, 101 bp, Artificial; identical to SEQ ID NO: 152
  mutated myrosinase

SEQ ID NO: 578 - DNA, 101 bp, Artificial; identical to SEQ ID NO: 224
  mutated myrosinase

SEQ ID NO: 579 - DNA, 123 bp, Artificial; identical to SEQ ID NO: 226
  mutated myrosinase

SEQ ID NO: 580 - DNA, 101 bp, Artificial; identical to SEQ ID NO: 155
  mutated myrosinase

SEQ ID NO: 581 - DNA, 101 bp, Artificial; identical to SEQ ID NO: 147
  mutated myrosinase

SEQ ID NO: 582 - DNA, 141 bp, Artificial
  mutated myrosinase
acaaacctatatatactcaccttatattttgtcctgtaaacatcgaccgcttatataaggtgagtatagttgcacatacatgatctggcggtcatcaaccttcggagaacatcgaccgggtgcatctgttccgattgcata

SEQ ID NO: 583 - DNA, 101 bp, Artificial; identical to SEQ ID NO: 150
  mutated myrosinase

SEQ ID NO: 584 - DNA, 102 bp, Artificial; identical to SEQ ID NO: 557
  mutated myrosinase

SEQ ID NO: 585 - DNA, 121 bp, Artificial; identical to SEQ ID NO: 146
  mutated myrosinase

SEQ ID NO: 586 - DNA, 101 bp, Artificial; identical to SEQ ID NO: 147
  mutated myrosinase

SEQ ID NO: 587 - DNA, 141 bp, Artificial; identical to SEQ ID NO: 582
  mutated myrosinase

SEQ ID NO: 588 - DNA, 141 bp, Artificial
  mutated myrosinase
acaaacctatatatactcaccttatattttgtcctgtaaacatcgaccgcttatataaggtgagtatagttgcacatacatgatctgggggtcatcaaccttcggagaacatcgaccgggtgcatctgttccgattgcata

SEQ ID NO: 589 - DNA, 101 bp, Artificial; identical to SEQ ID NO: 148
  mutated myrosinase

SEQ ID NO: 590 - DNA, 118 bp, Artificial
  mutated myrosinase
agaatttccggcgtaacatgtagaatcaacctttggagaacatcgaccagtgatcctaatccatagcatctcgtaggcactgagtagagctggttgattgtgaaccagtgctttactt

SEQ ID NO: 591 - DNA, 101 bp, Artificial; identical to SEQ ID NO: 149
  mutated myrosinase

SEQ ID NO: 592 - DNA, 101 bp, Artificial; identical to SEQ ID NO: 150
  mutated myrosinase

SEQ ID NO: 593 - DNA, 101 bp, Artificial; identical to SEQ ID NO: 151
  mutated myrosinase

SEQ ID NO: 594 - DNA, 101 bp, Artificial; identical to SEQ ID NO: 152
  mutated myrosinase

SEQ ID NO: 595 - DNA, 101 bp, Artificial; identical to SEQ ID NO: 147
  mutated myrosinase

SEQ ID NO: 596 - DNA, 108 bp, Artificial
  mutated myrosinase
acagacaagatttcaaagactatgcggatctatgtttcaaagaatttggtagaaaggttcacgatcaaccagctattcacagtgcctacgagaggctatgcactcgga

SEQ ID NO: 597 - DNA, 101 bp, Artificial; identical to SEQ ID NO: 154
  mutated myrosinase

SEQ ID NO: 598 - DNA, 105 bp, Artificial
  mutated myrosinase
cgttgaagaatttccggcgtaacatgtaggatcaacctttggagaacatctaccatgatcctaatccatagcctctcgtaggcactgagtagagctggttgattg

SEQ ID NO: 599 - DNA, 101 bp, Artificial; identical to SEQ ID NO: 155
  mutated myrosinase

SEQ ID NO: 600 - DNA, 114 bp, Artificial
  mutated AOP2
tttttggatgcacaaaaggcaaaaaaaaaagaaagaatgggtgcagacacgcctcaacttccagtctctcggaccaaaccctgaaaccaggaagtgagaagtgggctgaagtca

SEQ ID NO: 601 - DNA, 101 bp, Artificial
  mutated AOP2
aaaaggcaaaaaaaaaagaaagaatgggtgcagacactcctcaacttccagtctctcggaccaaaccctgaaaccaggaagtgagaagtgggctgaagtca

SEQ ID NO: 602 - DNA, 101 bp, Artificial
  mutated AOP2
aaaaggcaaaaaaaaaagaaagaatgggtgcagacactcctcaacttccattcatctatctctcggaccaaaccctgaaaccaggaagtgagaagtgggct

SEQ ID NO: 603 - DNA, 101 bp, Artificial
  mutated AOP2
agacactcctcaacttccagtcatctatctctcggaccaaaccctgaaactaggaagtgagaagtgggctgaagtcaggagtggtgtccgtaaagctctcg

SEQ ID NO: 604 - DNA, 101 bp, Artificial
  mutated AOP2
gagtggtgtccgtaaagctctcgaagaatatggtgctttcgaggtgtcatatgacagaggagcttaagaagtcagttttggatgccatgatagagcttttc

SEQ ID NO: 605 - DNA, 101 bp, Artificial
  mutated AOP2
gaccattatgagtagaatatccagtgtagggttttggagacacgtttctcttcatatgacacctcgaaagcgccgtagtcttcaagagctttacggacatc

SEQ ID NO: 606 - DNA, 115 bp, Artificial
  mutated AOP2
cttagcctcaactggtaagtcgaaaagctctttcatggcttccaaaaccgtaagctcctctgacacatatgacacctcgaaagcgccgtagtcttcaagagctttacggacatca

SEQ ID NO: 607 - DNA, 101 bp, Artificial
  mutated AOP2
taactcgaaaagctctttcatggcttccaaaaccgattgctttagctcctctcatatgacacctcgaaagctccgtagtcttcaagagctttacggacatc

SEQ ID NO: 608 - DNA, 101 bp, Artificial
  mutated AOP2
ctcgaaaagctctttcatggcttccaaaaccgattgctttagctcctctgatatcatatgacacctcgaaagctccgtagtcttcaagagctttacggaca

SEQ ID NO: 609 - DNA, 101 bp, Artificial
  mutated AOP2
ctcgaaaagctctttcatggcttccaaaaccgattgctttagctcctctgacatatgacacctcgaaagctccgtagtcttcaagagctttacggacatca

SEQ ID NO: 610 - DNA, 101 bp, Artificial
  mutated AOP2
agtggtgtccgtaaagctctcgaagaatatggtgctttcgaggtgtcatatgagtgacagaggagcttaagaagtcagttttggatgccatgatagagctt

SEQ ID NO: 611 - DNA, 101 bp, Artificial
  mutated AOP2
gtggtgtccgtaaagctctcgaagaatatggtgctttcgaggtgtcatatgagaggagcttaagaagtcagttttggatgccatgatagagcttttcgagt

SEQ ID NO: 612 - DNA, 101 bp, Artificial
  mutated AOP2
ggagtggtgtccgtaaagctctcgaagaatatggtgctttcgaggtgtcatagaggagcttaagaagtcagttttggatgccatgatagagcttttcgagt

SEQ ID NO: 613 - DNA, 101 bp, Artificial
  mutated AOP2
aactcgttaactttctccaaaacctcagcatcctggatccctagactctcgtaagaaaattaccgttggagttttcttgattctaagagacaacgttggta

SEQ ID NO: 614 - DNA, 101 bp, Artificial
  mutated AOP2
accagcttgatctctttcaatcaaagaaagactccaaaggtagttttcttaagagtctagggatccaggattccaatgttttggagaaagttaacgaattt

SEQ ID NO: 615 - DNA, 101 bp, Artificial; identical to SEQ ID NO: 601
  mutated AOP2

SEQ ID NO: 616 - DNA, 101 bp, Artificial; identical to SEQ ID NO: 604
  mutated AOP2

SEQ ID NO: 617 - protein, 457 aa, Brassica juncea
  misc_feature (15)..(15): Xaa can be any naturally occurring amino acid
MKHLWLTLAFLLALXTCKADEEITCEENLPFTCGQTDRFNSSSFEKDFIFGLASSAYQIEGSINRGVNVWDGFTHRFPDKAGPDHGNGDTTCNSYSYWEKDIEVMDELKATGYRFSIAWSRIIPGGKRSRGVHQGGINYYHGLINGLIDKGITPLVTLFHWDLPQVLQDDYEGFLDPQIDDFRDFADLCFEEYGDKVKHWFTINQLYSVPTRGYGLGSDAPGRCSPKVDSTCYAGNSSTEPYIVAHNQLLAHATVVDLYRTKYKHQGGKIGPVMITRWFLPYNDTDPDSIAATERMKEFFLGWYMGPLTNGTYPQIMIDTVGERLPSFTPEESKLVKGSYDFLGLNYYFTQYVQPSPNHVDSDGHTAMMDAGTRLTDRNASNHAIGPVETKNTYYYPKGIYYVMDHFKTNYNDPVIYITENLGFSTSGDETREEAKFDYRRIDYLCSHLCFLSKVIK

SEQ ID NO: 618 - protein, 457 aa, Brassica juncea
MKHLWLTLAFLLALATCKADEEITCEENLPFTCGQTDRFNSSSFEKDFIFGLASSAYQIEGSINRGVNVWDGFTHRFPDKAGPDHGNGDTTCNSYSYWEKDIEVMDELKATGYRFSIAWSRIIPGGKRSRGVHQGGINYYHGLINGLIDKGITPLVTLFHWDLPQVLQDDYEGFLDPQIDDFRDFADLCFEEYGDKVKHWFTINQLYSVPTRGYGLGSDAPGRCSPKVDSTCYAGNSSTEPYIVAHNQLLAHATVVDLYRTKYKHQGGKIGPVMITRWFLPYNDTDPDSIAATERMKEFFLGWYMGPLTNGTYPQIMIDTVGERLPSFTPEESKLVKGSYDFLGLNYYFTQYVQPSPNHVDSDGHTAMMDAGTRLTDRNASNHAIGPVETKNTYYYPKGIYYVMDHFKTNYNDPVIYITENLGFSTSGDETREEAKFDYRRIDYLCSHLCFLSKVIK

SEQ ID NO: 619 - protein, 457 aa, Brassica juncea; identical to SEQ ID NO: 618

SEQ ID NO: 620 - protein, 460 aa, Brassica juncea
MKLLHGLALVFLLAAASCKADEEITCEENNPFTCSNTDILSSKNFGKDFIFGVASSAYQIEGGRGRGVNIWDGFSHRYPEKSGSDLKNGDTTCESYTRWQKDVDVMGELNATGYRFSFAWSRIIPEGKVSRGVNQGGLDYYHKLIDALLEKNITPFVTLFHWDLPQTLQDEYEGFLDRQIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAALVAGSYDFLGLNYYVTQYAQPKPNPYPSETHTAMMDAGVKLTDDNSRGEFLGPLVNGNSYYYPKGIYYVMDYFKTKYGDPLIYVTENLGFSTPSEENREQAIADYKRIDYLCSHLCFLRKVIK

SEQ ID NO: 621 - protein, 460 aa, Brassica juncea; identical to SEQ ID NO: 620

SEQ ID NO: 622 - protein, 460 aa, Brassica juncea; identical to SEQ ID NO: 620

SEQ ID NO: 623 - protein, 460 aa, Brassica juncea
  misc_feature (145)..(145): Xaa can be any naturally occurring amino acid
MKLLHGLALVFLLAAASCKADEEITCEENNPFTCSNTDILSSKNFGKDFIFGVASSAYQIEGGRGRGVNVWDGFSHRYPEKSGSDLKNGDTTCESYTRWQKDVDVMGELNATGYRFSFAWSRIIPEGKVSRGVNQGGLDYYHKLXDALLEKNITPFVTLFHWDLPQTLQDEYEGFLDRQIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAELVAGSYDFLGLNYYVTQYAQPKPNPYPSETHTAMMDAGVKLTDDNSRGEFLGPLVNGNSYYYPKGIYYVMDYFKTKYGDPLIYVTENLGFSTPSSENREQAIADYKRIDYLCSHLCFLRKVIK

SEQ ID NO: 624 - protein, 460 aa, Brassica juncea; identical to SEQ ID NO: 623
  misc_feature (145)..(145): Xaa can be any naturally occurring amino acid

SEQ ID NO: 625 - protein, 460 aa, Brassica juncea
MKLLHGLALVFLLAAASCKADEEITCEENNPFTCSNTDILSSKNFGKDFIFGVASSAYQIEGGRGRGVNVWDGFSHRYPEKSGSDLKNGDTTCESYTRWQKDVDVMGELNATGYRFSFAWSRIIPEGKVSRGVNQGGLDYYHKLIDALLEKNITPFVTLFHWDLPQTLQDEYEGFLDRQIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAELVAGSYDFLGLNYYVTQYAQPKPNPYPSETHTAMMDAGVKLTDDNSRGEFLGPLVNGNSYYYPKGIYYVMDYFKTKYGDPLIYVTENLGFSTPSSENREQAIADYKRIDYLCSHLCFLRKVIK

SEQ ID NO: 626 - protein, 460 aa, Brassica juncea; identical to SEQ ID NO: 96

SEQ ID NO: 627 - protein, 460 aa, Brassica juncea; identical to SEQ ID NO: 96

SEQ ID NO: 628 - protein, 460 aa, Brassica juncea; identical to SEQ ID NO: 96

SEQ ID NO: 629 - protein, 460 aa, Brassica juncea
MKLLHGLALVFLLAAASCKADEEITCEENNPFTCSNTDILSSKNFGKDFIFGVASSAYQIEGGRGRGVNVWDGFSHRYPEKAGSDLKNGDTTCESYTRWQKDVDVMGELNATGYRFSFAWSRIIPEGKVSRGVNQGGLDYYHKLIDALLEKNITPFVTLFHWDLPQTLQDEYEGFLDRQIQDFKDYADLCFKEFGGKVKHWITINQLYTVPTRGYAIGTDAPGRCSPMVDTKHRCYGGNSSTEPYIVAHNQLLAHATVVDLYRTKYKFQKGKIGPVMITRWFLPYDESDPASIEAAERMNQFFHGWYMEPLTKGRYPDIMRQIVGSRLPNFTEEEAELVAGSYDFLGLNYYVTQYAQPKPNPYPSETHTAMMDAGVKLTDDNSRGEFLGPLVNGNSYYYPKGIYYVMDYFKTKYGDPLIYVTENLGFSTPSSENREQAIADYKRIDYLCSHLCFLRKVIK

SEQ ID NO: 630 - protein, 460 aa, Brassica juncea; identical to SEQ ID NO: 103

SEQ ID NO: 631 - protein, 460 aa, Brassica juncea; identical to SEQ ID NO: 629

SEQ ID NO: 632 - protein, 459 aa, Brassica juncea; identical to SEQ ID NO: 97

SEQ ID NO: 633 - protein, 459 aa, Brassica juncea; identical to SEQ ID NO: 97

SEQ ID NO: 634 - protein, 459 aa, Brassica juncea; identical to SEQ ID NO: 97

SEQ ID NO: 635 - protein, 460 aa, Brassica juncea; identical to SEQ ID NO: 98

SEQ ID NO: 636 - protein, 460 aa, Brassica juncea; identical to SEQ ID NO: 98

SEQ ID NO: 637 - protein, 460 aa, Brassica juncea; identical to SEQ ID NO: 98

SEQ ID NO: 638 - protein, 460 aa, Brassica juncea; identical to SEQ ID NO: 99

SEQ ID NO: 639 - protein, 460 aa, Brassica juncea; identical to SEQ ID NO: 99

SEQ ID NO: 640 - protein, 460 aa, Brassica juncea; identical to SEQ ID NO: 99

SEQ ID NO: 641 - protein, 460 aa, Brassica juncea
MKLLRRLALVFLLAAASCKADEEITCEENNPFTCSNTDILSSKNFGKDFIFGVASSAYQIEGGRGRGVNVWDGFSHRYPEKAGSDLKNGDTTCESYTRWQKDVDVMGEINATGYRFSFAWSRIIPEGKVSRGVNQGGLDYYHQLIDALLEKNITPFVTLFHWDLPQTLQDEYEGFLDRQIQDFKDYADLCFKEFGGKVKHWITINQLYTVPTRGYAVGTDAPGRCSPMVDTKHRCYGGNSSTEPYIVAHNQLLAHAAVVDLYRTKYKFQNGKIGPVMITRWFLPYDESDPACIEAAERMNQFFHGWYMEPLTKGRYPDIMRQIVGSRLPNFTEEEAALVAGSYDFLGLNYYVTQYARPQPNPYPSETHTAMMDAGVKLTDDNSRGEILGPLVNGNSYYYPKGIYYVMDFFKTNYSNPLIYITENLGISSPSTESRCEAIADYKRIDYLCSHLCFLRKVIK

SEQ ID NO: 642 - protein, 460 aa, Brassica juncea; identical to SEQ ID NO: 641

SEQ ID NO: 643 - protein, 460 aa, Brassica juncea; identical to SEQ ID NO: 641

SEQ ID NO: 644 - protein, 458 aa, Brassica juncea; identical to SEQ ID NO: 101

SEQ ID NO: 645 - protein, 458 aa, Brassica juncea; identical to SEQ ID NO: 101

SEQ ID NO: 646 - protein, 458 aa, Brassica juncea; identical to SEQ ID NO: 101

SEQ ID NO: 647 - protein, 458 aa, Brassica juncea
MKLHGLALIGFLIAAASCKAIEDINCQENEPFTCGNTDQLSSKNFPKDFIFGVASAAYQVEGGRGRGLNVWDGFTHRYPEKGGSDLGNGDTTCESYTRWQKDIDIMDELNATGYRFSFAWSRIIPEGKVSRGVNKGGLEYYHKLIDGLVAKNITPFVTLYHWDLPQTLQDEYEGFLNRTIDDFRDYADLCFKEFGGKVKNWITINQLYTVPTRGYAIGTDAPGRCSPKVDERCYGGNSSTEPYIVAHNQLLAHAAAVDVYRTKYKFQGGKIGPVMITRWFLPFDETDKASLYAADRMKEFFLGWFMEPLTKGRYPDIMRQIVGSRLPNFTEAEAELVAGSYDFLGLNYYTTQYAQPKPNPVTWENHTAMMDPGAKLTDTNSRGENLGPLINGDSYYYPKGIYYVMDYFKTKYRNPLIYITENLGFSTPGEETREEAIADSKRIDYLCSHLCFLRKVIR

SEQ ID NO: 648 - protein, 458 aa, Brassica juncea; identical to SEQ ID NO: 647

SEQ ID NO: 649 - protein, 458 aa, Brassica juncea
  misc_feature (379)..(379): Xaa can be any naturally occurring amino acid
MKLHGLALIGFLIAAASCKAIEDINCQENEPFTCGNTDQLSSKIFPKDFIFGVASAAYQVEGGRGRGLNVWDGFTHRYPEKGGSDLGNGDTTCESYTRWQKDIDIMDELNATGYRFSFAWSRIIPEGKVSRGVNKGGLEYYHKLIDGLVAKNITPFVTLYHWDLPQTLQDEYEGFLNRTIDDFRDYADLCFKEFGGKVKNWITINQLYTVPTRGYAIGTDAPGRCSPKVDERCYGGNSSTEPYIVAHNQLLAHAAAVDVYRTKYKFQGGKIGPVMITRWFLPFDETDKASLYAADRMKEFFLGWFMEPLTKGRYPDIMRQIVGSRLPNFTEAEAELVAGSYDFLGLNYYTTQYAQPKPNPVTWENHTAMMDPGAKLTDXNSRGENLGPLINGDSYYYPKGIYYVMDYFKTKYRNPLIYITENLGFSTPGEETREEAIADSKRIDYLCSHLCFLRKVIR

SEQ ID NO: 650 - protein, 459 aa, Brassica juncea
MKLLGLALVFLLASASCKADEEITCEENNPFTCSNTDILSSKNFGKDFIFGVASSAYQIEGGRGRGVNIWDGFSHRYPEKSGSDLKNGDTTCESYTRWQKDVDVMGELNATGYRFSFAWSRIIPEGKVSRGVNQGGLDYYHKLIDALLEKNITPFVTLFHWDLPQTLQDEYEGFLDRQIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAQLVAGSYDFLGLNYYVTQYAQPKPNPYPSETHTAMMDAGVKLTDDNSRGEFLGPLDNGNSYYYPKGIYYVMDYFKTNYGNPLIYVTENLGFSTPSSENREQAIADYKRIDYLCSHLCFLRKVIK

SEQ ID NO: 651 - protein, 459 aa, Brassica juncea; identical to SEQ ID NO: 650

SEQ ID NO: 652 - protein, 459 aa, Brassica juncea; identical to SEQ ID NO: 650

SEQ ID NO: 653 - protein, 457 aa, Brassica juncea; identical to SEQ ID NO: 104

SEQ ID NO: 654 - protein, 457 aa, Brassica juncea; identical to SEQ ID NO: 104

SEQ ID NO: 655 - protein, 457 aa, Brassica juncea; identical to SEQ ID NO: 104

SEQ ID NO: 656 - protein, 457 aa, Brassica juncea; identical to SEQ ID NO: 105

SEQ ID NO: 657 - protein, 457 aa, Brassica juncea; identical to SEQ ID NO: 105

SEQ ID NO: 658 - protein, 457 aa, Brassica juncea; identical to SEQ ID NO: 105

SEQ ID NO: 659 - protein, 428 aa, Brassica juncea
  misc_feature (187)..(187): Xaa can be any naturally occurring amino acid
  misc_feature (228)..(228): Xaa can be any naturally occurring amino acid
  misc_feature (264)..(264): Xaa can be any naturally occurring amino acid
MGSDSTPQLPVIYLSDQTLKPGSEKWVEVRNDVRKALEDYGAFEVSYDRVSEELKQSVLEAMKELFELPVEAKRRNVSPKPYTGYSTHNGLSESLGIQDAEVLEKVNEFTQLLRPDFEGNKSISETIQKFSEKLAELDVMVRRMVMESFGIEKYFDEHLKSTNYRLRLMKYIAPPDVDTNVAAGANXAGDGANDAGASDNANVVADTSDIASGIANVHINDDANIGAXANGDIGADVDAKTSDFASVESKADVSTNVNANADAXANTGTLSSAGVGDSVTANGGADDEEKKLGLPSHTDKNLFTVLYQYEIEGLEVLTKDEKWIRLKPSHNSFVVMAGDSVYALMNGRLFRPFHRVRVTEKKKTRYSIALFSTPNAGYIIEPPKELVDEKHPRVFKPFTYVDLMSFYHTEGGRRARSTLHAYCAVSEA

SEQ ID NO: 660 - protein, 428 aa, Brassica juncea
MGSDSTPQLPVIYLSDQTLKPGSEKWVEVRNDVRKALEDYGAFEVSYDRVSEELKQSVLEAMKELFELPVEAKRRNVSPKPYTGYSTHNGLSESLGIQDAEVLEKVNEFTQLLRPDFEGNKSISETIQKFSEKLAELDVMVRRMVMESFGIEKYFDEHLKSTNYRLRLMKYIAPPDVDTNVAAGANGAGDGANDAGASDNANVVADTSDIASGIANVHINDDANIGAKANGDIGADVDAKTSDFASVESKADVSTNVNANADADANTGTLSSAGVGDSVTANGGADDEEKKLGLPSHTDKNLFTVLYQYEIEGLEVLTKDEKWIRLKPSHNSFVVMAGDSVYALMNGRLFRPFHRVRVTEKKKTRYSIALFSTPNAGYIIEPPKELVDEKHPRVFKPFTYVDLMSFYHTEGGRRARSTLHAYCAVSEA

SEQ ID NO: 661 - protein, 427 aa, Brassica juncea
MGSDSTPQLPVIYLSDQTLKPGSEKWVEVRNDVRKALEDYGAFEVSYDRVSEELKQSVLEAMKELFELPVEAKRRNVSPKPYTGYSTHNGLSESLGIQDAEVLEKVNEFTQLLRPDFEGNKSISETIQKFSEKLAELDVMVRRMVMESFGIEKYFDEHLKSTNYRLRLMKYIAPPDVDTNVAAGANGAGDGANDAGASDNANVVADTSDIASGIANVHINDDANIGAKANGDIGADVDAKTSDFASVESKADVSTNVNANADADANTGTLSSAGVGDSVTANGGADDEKKLGLPSHTDKNLFTVLYQYEIEGLEVLTKDEKWIRLKPSHNSFVVMAGDSVYALMNGRLFRPFHRVRVTEKKKTRYSIALFSTPNAGYIIEPPKELVDEKHPRVFKPFTYVDLMSFYHTEGGRRARSTLHAYCAVSEA

SEQ ID NO: 662 - protein, 439 aa, Brassica juncea; identical to SEQ ID NO: 130

SEQ ID NO: 663 - protein, 439 aa, Brassica juncea
MGADTPQLPVIYLSDQTLKPGSEKWVEVRSDVRKALEDYGGFEVSYDRVSEELKKSVLDAMIELFELPVEAKQRNVSPKPYTGYSTHNGLSESLGIQNSNVLEKVNEFTQLLRPDCEGNKSMSETIQNFSEKLAELDVMVRRMVIESFGIENYFDEHLKSTNYRLRLMKYVAPPDVDANVAVGTKDSDDGANTNTTANADADDIANGIAKVHIDDDADAKGDVCTGAGTNHNGDDVNTGDCANVKSNVDVGTNVSAKSSVGADVNTGTIDDVNANAGTRSSANVGVSDSVKANGGADDEEKKLGLPSHTDKNLLTVLYQYEIEGLEVLTKDEKWIRLKPSHNSFVVMAGDSLYALMNGRLSRPFHRVRVTERKKTRYSIALFSTPNGDYIIEPPKELVDEKHPRLFKPFTYVDLMSFYHTEAGRRARSTLHAYCAVSGA

SEQ ID NO: 664 - protein, 439 aa, Brassica juncea; identical to SEQ ID NO: 130

SEQ ID NO: 665 - protein, 439 aa, Brassica juncea
  misc_feature (223)..(223): Xaa can be any naturally occurring amino acid
MGADTPQLPVIYLSDQTLKPGSEKWAEVRSGVRKALEEYGAFEVSYDRVTEELKKSVLDAMIELFELPVEAKQRNVSPKPYMGYSTHNGLSESLGIQDPNVLEKVNEFTQLLRPDCEGNKSMSETIQKFSEKLVELDVTVKRMVIQSFGIENYFDEHLKSLKNYRMRLMKYVAPPDVDAKDADDGANTNLNANADADAGAGDIANGIANVHIDEDVNAKGDVXTGGGDANHNGDDANTGDSASVKSNVDVGTDVNVKASVGADVNVGTIADANANIGTLSSANVGVGDSVKANGGADDEEKKLGLPSHTDKNLLTVLYQYEIDGLEVLTKDEKWIRLKPAHNSFVVIAGDSLYALMNGRLSRPFHRVRVTERKKTRYSIALFSAPDGDYIIEPPKELVDEKHPRLFKPFTYADLMSFYHTEAGRRSRSTLDAYSAVSGA

SEQ ID NO: 666 - protein, 439 aa, Brassica juncea; identical to SEQ ID NO: 132

SEQ ID NO: 667 - protein, 439 aa, Brassica juncea
MGADTPQLPVIYLSDQTLKPGSEKWAEVRSGVRKALEEYGAFEVSYDRVTEELKKSVLDAMIELFELPVEAKQRNVSPKPYMGYSTHNGLSESLGIQDPNVLEKVNEFTQLLRPDCEGNKSMSETIQKFSEKLVELDVTVKRMVIQSFGIENYFDEHLKSLKNYRMRLMKYVAPPDVDAKDADDGANTNLNANADADAGAGDIANGIANVHIDEDVNAKGDVCTGGGDANHNGDDANTGDSASVKSNVDVGTDVNVKASVGADVNVGTIADANANIGTLSSANVGVGDSVKANGGADDEEKKLGLPSHTDKNLLTVLYQYEIDGLEVLTKDEKWIRLKPAHNSFVVIAGDSLYALMNGRLSRPFHRVRVTERKKTRYSIALFSAPDGDYIIEPPKELVDEKHPRLFKPFTYADLMSFYHTEAGRRSRSTLDAYSAVSGA

SEQ ID NO: 668 - protein, 434 aa, Brassica juncea
MGSDSTPQLPVIYLSDQTLKPGSEKWVEVRSDVRKALEDYGAFEVSYDRVSEELKESVLEAMKELFDLPVEAKQRNVSPKPYTGYSTHNGLSESLGIQDAEVLEKVNEFTQLLRPDCEGNKSIRETIQKFSEKLAELDVMVRRMVMESFGIEKYFDEHLKSTNYRLRLMKYIAPPEVDTNVAVGANDAGDGANDASASDKANVVAGDEDNVGADTSDIANGIANVHIDDDAKANGDIGADVDAKTSDCANVESKADVSTDVNANSDSNANTGTLSSASVGDIVKANGGADDEEKKLGLPSHTDKNLFTVLYQYEIEGLEVLTKDEKWIRLKPSHNSFVVMAGDSAYLQALMNGRLFRPFHRVRVTEKKKTRYSIALFSTPNAGNIIEPPKELVDEKHPRVFKPFTYVDLMSFYHTEAGRRARSTLHAYCAVSEA

SEQ ID NO: 669 - protein, 434 aa, Brassica juncea; identical to SEQ ID NO: 668

SEQ ID NO: 670 - protein, 434 aa, Brassica juncea; identical to SEQ ID NO: 668

SEQ ID NO: 671 - protein, 435 aa, Brassica juncea
MGSDSTPQLPVIHLSDQTLKPGSEKWVEVRSDVRKALEDYGAFEVSYDRVSEELKESVLEAMKELFQLPVEAKRRNVSPKPYTGYMTHNGISESLGIQDANVLEKVNEFTQLLRPDCEGNKSTRSVLLMAELDVMVRRMVFESFGIEDYFDENLKSMNYRLRLMKYSAPRDVDTNVAAGANDAGDAANTNNNGNTGADVGAGDSASTGDNDKVVASDDANAGADTNDIVVGIANVHIDDDANDVAKANGDVGAGVDANTNDCASVKSSADVDNVNANVSVGTNGDTNANVGADIEEKKLGLPSHTDKNLLTVLYQYEIEGLEVLTKDEKWIRVKPSHNTFVVIAGDSLHALMNGRLFLPFHRVRVTEKKKTRYSIGLFSTPNRDYIIEPPKELVDEQHPRVFKPLTYVDLMSFYHTEVGRRARSTLHAYCAVSGA

SEQ ID NO: 672 - protein, 435 aa, Brassica juncea; identical to SEQ ID NO: 671

SEQ ID NO: 673 - protein, 435 aa, Brassica juncea; identical to SEQ ID NO: 671

SEQ ID NO: 674 - protein, 516 aa, Brassica juncea
MASISLLGRILSRPTKTKDRSRQLPPGPPGWPILGNLPELMMTRPRHKYIDIALKGQKPEIACFNFAGTHAIVINSDEIAREALKERDADFADRPNLFNMRTIGGNHKSMGNSPYGEQFMKMKRVITTEIMSVKTLNMLVAARTVEADNLLAYLLSMYKRSETADVREFSRVYGYAVTMRLLFGRRHITKENVFSDEGRLGQAEKDHLDAIFETLNCLPSFSPADYLEKWFRGWNIDGQEERVVMYCNKVRSYNNPIIDERVELWREKGGKAAVEDWIDTFITLKDENGKYYITPDEVKAQCVEFCIAAIDNPANNMEWTLAEMLKNPEILKKALKELDEVVGRDRLVQESDIPNLNYLKACCRETFRIHPSAHYVPTHVARQDTTLGGYFIPKGSHIHVGRPGIGRSSKVWKDPLVYKPERHLEGDGISKELSLVESELRFVSFGTGRRGCVGVKVGTIMMVIMLARFLQAFNWKLHPGYGPLSLEEDDALLMAKPLLLSVEPRLAPNLYPKFCP

SEQ ID NO: 675 - protein, 516 aa, Brassica juncea
  misc_feature (301)..(301): Xaa can be any naturally occurring amino acid
MASISLLGRILSRPTKTKDRSRQLPPGPPGWPILGNLPELMMTRPRHKYIDIALKGQKPEIACFNFAGTHAIVINSDEIAREALKERDADFADRPNLFNMRTIGGNHKSMGNSPYGEQFMKMKRVITTEIMSVKTLNMLVAARTVEADNLLAYLLSMYKRSETADVREFSRVYGYAVTMRLLFGRRHITKENVFSDEGRLGQAEKDHLDAIFETLNCLPSFSPADYLEKWFRGWNIDGQEERVVMYCNKVRSYNNPIIDERVELWREKGGKAAVEDWIDTFITLKDENGKYYITPDEVKAXCVEFCIAAIDNPANNMEWTLAEMLKNPEILKKALKELDEVVGRDRLVQESDIPNLNYLKACCRETFRIHPSAHYVPTHVARQDTTLGGYFIPKGSHIHVGRPGIGRSSKVWKDPLVYKPERHLEGDGISKELSLVESELRFVSFGTGRRGCVGVKVGTIMMVIMLARFLQAFNWKLHPGYGPLSLEEDDALLMAKPLLLSVEPRLAPNLYPKFCP

SEQ ID NO: 676 - protein, 516 aa, Brassica juncea; identical to SEQ ID NO: 674

SEQ ID NO: 677 - protein, 541 aa, Brassica juncea
MTMMMMSLTTSLPYPFQILLVFILSIASITLLGRILSRPTKTKDRSRQLPPGPPGWPILGNLPELMKTRPRHKYFEIATKGQKPEIACFNFAGTHTIIINSDEIAREAFKERDADFADRPNTFNMRTIGGNHKSMGNTPTGEQFMKMKRVITSEIMSVKTLNMLVASRNIEADNLLAYLLSIYKRSETADVREISRNYGYAVTMRMMFGRRHVTKENVFSDEGRLGPAEKDHLDAIFETLNCLPSFSPADYLEKWFLGWNVDGLEERVTVNCNKVRSYNNPIIDERVELWREKGGKAAVEDWIDTFITLKDENGKYYITPDEVKGQCVEFCIAAIDNPANNMEWTLAEMLKNPEILKKALKELDEVVGRDRLVQESDIPNLNYLKACCRETFRVHPSAHYVPTHVARRDSTLGGYFIPKGSHIHVARPGIGRSSKVWKDPLVYKPERHLEGNGISKELSLVENEMRLVSFGTGRRGCIGVKVGTIMMVIMLARFLQAFNWKLHPSYGPLSLEEDDALLMAKPLLLSVEPRLAPNLYPKFYP

SEQ ID NO: 678 - protein, 541 aa, Brassica juncea; identical to SEQ ID NO: 115

SEQ ID NO: 679 - protein, 541 aa, Brassica juncea; identical to SEQ ID NO: 677

SEQ ID NO: 680 - DNA, 2361 bp, Brassica juncea
atgaagcatctttggctcacattagcttttctattggctttgkcgacttgcaaagctgatgaagaaattacttgcgaagagaacctgccattcacatgtggtcaaactgatcgtttcaacagtagcagtttcgagaaagacttcatcttcggtcttgcatcttctgcttaccaggcatgtaacatatatatatcaaccattagtattatgttgccagacgtcatattttacgtataaaacatcatatataaacattaaaatctaacgttgcatggttgtttcttttcatttcagatcgaaggtagcataaatcgtggagttaacgtttgggatggcttcactcaccgattcccacgtttgttttttgcatggttactcatcacatatacatattatgtcggttatatgtctccatgcacttatagttatgtatttatttaccatcagataaagcaggacccgatcatggaaatggagacactacttgtaactcatattcgtactgggaggtaattaaattcctcaatatatatgtgtgtgcatattaatattactcactgaattatttatcaactaccaacctagtgtggattgacatgcgattatatgtgaactgcagaaagatatagaggtgatggatgaactcaaagctactggctacagattctccattgcctggtcaagaatcattccaagtatgtgaacgttattgatccatgtatatatataaatcgtatatggtaatattcgattatgattctttcgaaagattaaatataggatacatatgagcaggaggaaagaggagcaggggagtacaccaaggaggtattaactactaccacggactcataaatggcctcatcgacaagggtataacgcctttagttacgctctttcactgggaccttcctcaagtactacaagatgactatgaaggtttcttggaccctcagatcatgtatgctatatttatgccatgctgcttattaagaaagacgacaatatataaagatttgttcttggattaatgaaatgactataatattcgcagagatgatttcagagatttcgcggatctatgttttgaagaatatggtgataaagtaaagcactggttcacaatcaaccagctctactcagtgcctacgagaggctatggattaggatcagatgcacctggtcgatgttctccaaaggttgattctacatgttacgccggaaattcttcaacggaaccctatattgttgcacataaccagctccttgctcatgccacggtggtcgatctttacaggacaaaatataaggcaggttctccattttatgaaaggtgtattatctgattctaaattaatcttatcgttgggtatatatatctgcgtgaccacagcatcaaggaggtaagattggacctgtgatgataactagatggtttcttccatataatgacactgatccagactccatagctgcaaccgagaggatgaaagaattcttcttgggatggtatatgttttataaaatgaaatgatatacttaacatgaatatatgctgtatatatgaactgacgaaaaatatgtatttatatgtacaccaggtacatggggccgctaacaaatggtacataccctcaaatcatgatagacactgtgggtgagcggcttccatcgttcactccagaggaatccaaactcgtaaagggttcatatgattttcttggtctcaactattacttcactcagtatgtccagccaagtcctaatcatgttgattcggatggtcacactgccatgatggacgctggcacaaggctcacatgtatccatctatatatttcgacttagttacaaccttaatttatatctacctaacgccttttgttaattacaataatttgtgttaacagatcgtaatgcaagtaatcatgccattggcccagtggtatatatatatatatgcatcaaccatccctattctttcattcttttttctaagcaaaattcagttttctgatactaatttgcttccctttctaagttcactgaacacaaagatgacgagaccaaaaacacctattactacccaaaaggcatttattatgtgatggatcacttcaaaaccaattacaatgaccctgtaatctatataaccgagaacggtgggttctactactcatctctaaattcatctttacatgttaaatgtaatttgaaatttgttgaaattgttcatgttatgacggttaactaggattcagtacctccggtgatgaaacccgtgaggaggctaagtttgattacaggcggattgattatctctgcagtcatctctgtttcctcagtaaagtcatcaagtga

SEQ ID NO: 681 - DNA, 2361 bp, Brassica juncea
atgaagcatctttggctcacattagcttttctattggctttggcaacttgcaaagctgatgaagaaattacttgcgaagagaacctgccattcacatgtggtcaaactgatcgtttcaacagtagcagtttcgagaaagacttcatcttcggtcttgcatcttctgcttaccaggcatgtaacatatatatatcaaccattagtattatgttgccagacgtcatattttacgtataaaacatcatatataaacattaaaatctaacgttgcatggttgtttcttttcatttcagatcgaaggtagcataaatcgtggagttaacgtttgggatggcttcactcaccgattcccacgtttgttttttgcatggttactcatcacatatacatattaggtcggttatatgtctccatgcacttatagttatgtatttatttaccatcagataaagcaggacccgatcatggaaatggagacactacttgtaactcatattcgtactgggaggtaattaaattcctcaatatatatgtgtgtgcatattaatattactcactgaattatttatcgactaccaacctagtgtggattgacatgcgattatatgtgaactgcagaaagatatagaggtgatggatgaactcaaagctactggctacagattctccattgcctggtcaagaatcattccaagtatgtgaacgttattgatccatgtatatatataaatcgtatatggtaatattcgattatgattctttcgaaagattaaatataggatacatatgagcaggaggaaagaggagcaggggagtacaccaaggaggtattaactactaccacggactcataaatggcctcatcgacaagggtataacgcctttagttacgctctttcactgggaccttcctcaagtactacaagatgactatgaaggtttcttggaccctcagatcatgtatgctatatttatgccatgctgcttattaagaaagacgacaatatataaagatttgttcttggattaatgaaatgactataatattcgcagagatgatttcagagatttcgcggatctatgttttgaagaatatggtgataaagtaaagcactggttcacaatcaaccagctctactcagtgcctacgagaggctatggattaggatcagatgcacctggtcgatgttctccaaaggttgattctacatgttacgccggaaattcttcaacggaaccctatattgttgcacataaccagctccttgctcatgccacggtggtcgatctttacaggacaaaatataaggcaggttctccattttatgaaaggtgtattatctgattctaaattaatcttatcgttgggtatatatatctgcgtgaccacagcatcaaggaggtaagattggacctgtgatgataactagatggtttcttccatataatgacactgatccagactccatagctgcaaccgagaggatgaaagaattcttcttgggatggtatatgttttataaaatgaaatgatatacttaacatgaatatatgctgtatatatgaactgacgaaaaatatgtatttatatgtacaccaggtacatggggccgctaacaaatggtacataccctcaaatcatgatagacactgtgggtgagcggcttccatcgttcactccagaggaatccaaactcgtaaagggttcatatgattttcttggtctcaactattacttcactcagtatgtccagccaagtcctaatcatgttgattcggatggtcacactgccatgatggacgctggcacaaggctcacatgtatccatctatatatttcgacttagttacaaccttaatttatatctacctaacgccttttgttaattacaataatttgtgttaacagatcgtaatgcaagtaatcatgccattggcccagtggtatatatatatatatgcatcatccatccctattctttcattcttttttctaagcaaaattcagttttctgatactaatttgcttccctttctaagttcactgaacacaaagatgacgagaccaaaaacacctattactacccaaaaggcatttattatgtgatggatcacttcaaaaccaattacaatgaccctgtaatctatataaccgagaacggtgggttctactactcatctctaaattcatctttacatgttaaatgtaatttgaaatttgttgaaattgttcatgttatgacggttaactaggattcagtacctccggtgatgaaacccgtgaggaggctaagtttgattacaggcggattgattatctctgcagtcatctctgtttcctcagtaaagtcatcaagtga

SEQ ID NO: 682 - DNA, 2356 bp, Brassica juncea
atgaagcatctttggctcacattagcttttctattggctttggcgacttgcaaagctgatgaagaaattacttgcgaagagaacctgccattcacatgtggtcaaactgatcgtttcaacagtagcagtttcgagaaagacttcatcttcggtcttgcatcttctgcttaccaggcatgtaacatatatatatcaaccattagtattatgttgccagacgtcatattttacgtataaaacatcatatataaacattaaaatctaacgttgcatggttgtttcttttcatttcagatcgaaggtagcataaatcgtggagttaacgtttgggatggcttcactcaccgattcccacgtttgtttttttgcatggttactcatcacatatacatattatgtcggttatatgtctccatgcatttatagttatgtatttatttactatcagataaagcaggacccgatcatggaaatggagacactacttgtaactcatattcgtactgggaggtaattaaattcctcaatatatatgtgtgtgcatattaatattactcactgaattatttatcaactaccaacctagtgtggattgacatgcgattatatgtgaactgcagaaagatatagaggtaatggatgaactcaaagctactggctacagattctccattgcctggtcaagaatcattccaagtatgtgaacgttattgatccatgtatatatataaatcatatatggtaatattcgattatgattctttcgaaagattaaatataggatacatatgagcaggaggaaagaggagcaggggagtacaccaaggaggtattaactactaccacggactcataaatggcctcatcgacaagggtataacgcctttagttacgctctttcactgggaccttcctcaagtactacaagatgactatgaaggtttcttggaccctcagatcatgtatgttatatttatgccatgctgcttattaagaaggacgacaatatataaagatttgttctgggattaatgaaatgactataatattcgcagagatgatttcagagatttcgcggatctatgttttgaagaatatggtgataaagtaaagcactggttcacaatcaaccagctctactcagtgcctacgagaggctatggattaggatcagatgcacctggtcgatgttctccaaaggttgattctacatgttacgccggaaattcttcaacggaaccctatattgttgcacataaccagctccttgctcatgccacggtggtcgatctttacaggacaaaatataaggcaggttctccattttatgaaaggtgtattatctgattctaaattaatcttatcgttgggtatatatatctgcgtgaccacagcatcaaggaggtaagattggacctgtgatgataactagatggtttcttccatataatgacactgatccagactccatagctgcaaccgagaggatgaaagaattcttcttgggatggtatatgttttataaaatgaaatgatattcttaacatgaatatatgctgtatatatgaactgacgaaaaatatgtatttatatgtacaccaggtacatggggccgctaacaaatggtacataccctcaaatcatgatagacactgtgggtgagcggcttccatcgttcactccagaggaatccaaactcgtaaagggttcatatgattttcttggtctcaactattacttcactcagtatgtccagccaagtcctaatcatgttgattcggatggtcacactgccatgatggacgctggcacaaggctcacatgtatccatctatatatttcgacttagttacaaccttaatttatatctacctaacgccttttgttaattacaataatttgtgttaacagatcgtaatgcaagtaatcatgccattggcccagtggtatatatatgcatcaaccatccctattctttcattcttttttctaagcaaaattcagttttctgatactaatttgcttccctttctaagttcactgaacacaaagatgacgagaccaaaaacacctattactacccaaaaggcatttattatgtgatggatcacttcaaaaccaattacaatgaccctgtaatctatataaccgagaacggtgggttctactactcatctctaaattcatctttacatgttaaatgtaatttgaaatttgttgaaattgttcatgttatgacggttaactaggattcagtacctccggtgatgaaacccgtgaggaggctaagtttgattacaggcggattgattatctctgcagtcatctctgtttcctcagtaaagtcatcaagtga

SEQ ID NO: 683 - DNA, 2379 bp, Brassica juncea
atgaagcttcttcatggactcgctttagtttttctattagctgctgcgagttgcaaagctgatgaagaaattacttgcgaagagaacaatccattcacatgtagtaacactgatattttaagcagtaaaaacttcggaaaagacttcatcttcggtgttgcatcttctgcttaccaggcatgtaacaaatttttttgacgtataaataaatacaattcaaaaatactaaaatgcaacttcgcatggttgtttcttttcatttcagatcgaaggaggaagaggtcgtggtgttaacatttgggatggcttcagtcaccgatatccaggtacgtcacagtgtatatatacacatgagatgaacgtcggtttatatgtacacatattaatgtatttgtaactactatcagagaaatcagggtcagatttgaagaatggagacactacttgtgagtcatatacgagatggcaggttaatacattgatactcatatgactgaactatatatgtataaaaactatacgtgtggattgacatgtgattaaaatatgtaaaccgcagaaagatgtagacgtgatgggcgaactcaatgctactggctacaggttctcctttgcgtggtcaagaatcattccaagtatgtacatgttatcgattcgtttgtattttaattgggatcatttagttgagaaaagtactaattaatgtacgacatatatatacatgagcagaaggaaaggtgagtaggggagtgaaccaaggaggtcttgattactaccacaaactcatagatgcactactcgaaaagaatataacgcctttcgttaccctctttcactgggaccttcctcaaacactccaagatgagtatgaaggtttcttagaccgccagatcatgtatgtttatatttgttccatgcttcttatattataaataagagaagaaaacgttttggttttagttacatgcattaatgaaatgattctatataatatgcacagacaagatttcaaagactacgcggatctatgtttcaaagaatttggtggaaaggtaaagcactggatcacgatcaaccagctatacacagtccctacgagaggctatgcggtcggaacagatgcacccggtcgatgttctcctatggttgataccaagcacaggtgttacggtggaaattcttcaacagaaccctacatcgttgcacataaccagcttcttgctcatgccacggtcgtcgatctttacaggaccaaatataaggtgagtggtctctccatattaaggtggtgcaaatctaacatatctgattctaatgtatagtcatatatatatatatatcacgtgaccaacagtttcaaaaagggaagattggacctgtgatgataacaagatggtttcttccatttgatgagtctgatcctgcctccatagaagcagctgagaggatgaaccaattctttcatggatggtatatatatatattacagaacaatgtaacagtatatagtgtatgtatgtataattaaaagatatacatggatcaggtacatggagccgctaacaaagggtagatacccagacatcatgaggcagattgtgggtagtaggcttcccaactttaccgaggaagaagccgcactcgttgccggttcatatgattttcttggtctcaactattacgtcactcagtacgcccagccaaaacctaacccatatccttcagagacacacactgccatgatggacgctggcgtaaagctcacatgtactagtctattaccactaattagatacagcctttctatacatataaatattcttttatctcctttttgttgcaacatactttgtgagtgaccatctgttatttcatccttgtgtttacagatgataactcacgtggtgaatttcttggtccactggtatatatcaatgatccaccccctaagatttgtttttctttcattttttcagttttcagtataacaaccctaattatgttttttaattgatgtgtatatttatttacttccattttcacagttcgttgaagacaaggtaaacggcaacagctattactacccaaaaggcatttactacgtaatggactacttcaaaaccaaatacggagaccctttaatctatgtcaccgagaacggtgagttttacgaactcttttcatytataccacataataattattgtattttgatattagtcgaagaaactgactttattgtggaatatttttaatgtggcggtttatttaggatttagtacccccagtgaagaaaaccgtgagcaggctattgccgattacaagcgaattgattatctctgcagtcatttatgttttctccgcaaggtcatcaagtga

SEQ ID NO: 684 - DNA, 2379 bp, Brassica juncea
atgaagcttcttcatggactcgctttagtttttctattagctgctgcgagttgcaaagctgatgaagaaattacttgcgaagagaacaatccattcacatgtagtaacactgatattttaagcagtaaaaacttcggaaaagacttcatcttcggtgttgcatcttctgcttaccaggcatgtaacaaatttttttgacgtataaataaatacaattcaaaaatactaaaatgcaacttcgcatggttgtttcttttcatttcagatcgaaggaggaagaggtcgtggtgttaacatttgggatggcttcagtcaccgatatccaggtacgtcacagtgtatatatacacatgagatgaacgtcggtttatatgtacacatattaatgtatttgtaactactatcagagaaatcagggtcagatttgaagaatggagacactacttgtgagtcatatacgagatggcaggttaatacattgatactcatatgactgaactatatatgtataaaaactatacgtgtggattgacatgtgattaaaatatgtaaaccgcagaaagatgtagacgtgatgggcgaactcaatgctactggctacaggttctcctttgcgtggtcaagaatcattccaagtatgtacatgttatcgattcgtttgtattttaattgggatcatttagttgagaaaagtactaattaatgtacgacatatatatacatgagcagaaggaaaggtgagtaggggagtgaaccaaggaggtcttgattactaccacaaactcatagatgcactactcgaaaagaatataacgcctttcgttaccctctttcactgggaccttcctcaaacactccaagatgagtatgaaggtttcttagaccgccagatcatgtatgtttatatttgttccatgcttcttatattataaataagagaagaaaacgttttggttttagttacatgcattaatgaaatgattctgtataatatgcacagacaagatttcaaagactacgcggatctatgtttcaaagaatttggtggaaaggtaaagcactggatcacgatcaaccagctatacacagtccctacgagaggctatgcggtcggaacagatgcacccggtcgatgttctcctatggttgataccaagcacaggtgttacggtggaaattcttcaacagaaccctacatcgttgcacataaccagcttcttgctcatgccacggtcgtcgatctttacaggaccaaatataaggtgagtggtctctccatattaaggtggtgcaaatctaacatatctgattctaatgtatagtcatatatatatatatatcacgtgaccaacagtttcaaaaagggaagattggacctgtgatgataacaagatggtttcttccatttgatgagtctgatcctgcctccatagaagcagctgagaggatgaaccaattctttcatggatggtatatatatatattacagaacaatgtaacagtatatagtgtatgtatgtataattaaaagatatacatggatcaggtacatggagccgctaacaaagggtagatacccagacatcatgaggcagattgtgggtagtaggcttcccaactttaccgaggaagaagccgcactcgttgccggttcatatgattttcttggtctcaactattacgtcactcagtacgcccagccaaaacctaacccatatccttcagagacacacactgccatgatggacgctggcgtaaagctcacatgtactagtctattaccactaattagatacagcctttctatacatataaatattcttttatctcctttttgttgcaacrtactttrtgagtgaccatctgttatttcatccttgtgtttacagatgataactcacgtggtgaatttcttggtccactggtatatatcaatgatccaccccctaagatttgtttttctttcattttttcagttttcagtataacaaccctaattatgttttttaattgatgtgtatatttatttacttccattttcacagttcgttgaagacaaggtaaacggcaacagctattactacccaaaaggcatttactacgtaatggactacttcaaaaccaaatacggagaccctttaatctatgtcaccgagaacggtgagttttacgaactcttttcatttataccacataataattattgtattttgatattagtcgaagaaactgactttattgtggaatatttttaatgtggcggtttatttaggatttagtacccccagtgaagaaaaccgtgagcaggctattgccgattacaagcgaattgattatctctgcagtcatttatgttttctccgcaaggtcatcaagtga

SEQ ID NO: 685 - DNA, 2379 bp, Brassica juncea
atgaagcttcttcatggactcgctttagtttttctattagctgctgcgagttgcaaagctgatgaagaaattacttgcgaagagaacaatccattcacatgtagtaacactgatattttaagcagtaaaaacttcggaaaagacttcatcttcggtgttgcatcttctgcttaccaggcatgtaacaaatttttttgacgtataaataaatacaattcaaaaatactaaaatgcaacttcgcatggttgtttcttttcatttcagatcgaaggaggaagaggtcgtggtgttaacatttgggatggcttcagtcaccgatatccaggtacgtcacagtgtatatatacacatgagatgaacgtcggtttatatgtacacatattaatgtatttgtaactactatcagagaaatcagggtcagatttgaagaatggagacactacttgtgagtcatatacgagatggcaggttaatacattgatactcatatgactgaactatatatgtataaaaactatacgtgtggattgacatgtgattaaaatatgtaaaccgcagaaagatgtagacgtgatgggcgaactcaatgctactggctacaggttctcctttgcgtggtcaagaatcattccaagtatgtacatgttatcgattcgtttgtattttaattgggatcatttagttgagaaaagtactaattaatgtacgacatatatatacatgagcagaaggaaaggtgagtaggggagtgaaccaaggaggtcttgattactaccacaaactcatagatgcactactcgaaaagaatataacgcctttcgttaccctctttcactgggaccttcctcaaacactccaagatgagtatgaaggtttcttagaccgccagatcatgtatgtttatatttgttccatgcttcttatattataaataagagaagaaaacgttttggttttagttacatgcattaatgaaatgattctgtataatatgcacagacaagatttcaaagactacgcggatctatgtttcaaagaatttggtggaaaggtaaagcactggatcacgatcaaccagctatacacagtccctacgagaggctatgcggtcggaacagatgcacccggtcgatgttctcctatggttgataccaagcacaggtgttacggtggaaattcttcaacagaaccctacatcgttgcacataaccagcttcttgctcatgccacggtcgtcgatctttacaggaccaaatataaggtgagtggtctctccatattaaggtggtgcaaatctaacatatctgattctaatgtatagtcatatatatatatatatcacgtgaccaacagtttcaaaaagggaagattggacctgtgatgataacaagatggtttcttccatttgatgagtctgatcctgcctccatagaagcagctgagaggatgaaccaattctttcatggatggtatatatatatattacagaacaatgtaacagtatatagtgtatgtatgtataattaaaagatatacatggatcaggtacatggagccgctaacaaagggtagatacccagacatcatgaggcagattgtgggtagtaggcttcccaactttaccgaggaagaagccgcactcgttgccggttcatatgattttcttggtctcaactattacgtcactcagtacgcccagccaaaacctaacccatatccttcagagacacacactgccatgatggacgctggcgtaaagctcacatgtactagtctattaccactaattagatacagcctttctatacatataaatattcttttatctcctttttgttgcaacatactttgtgagtgaccatctgttatttcatccttgtgtttacagatgataactcacgtggtgaatttcttggtccactggtatatatcaatgatccaccccctaagatttgtttttctttcattttttcagttttcagtataacaaccctaattatgttttttaattgatgtgtatatttatttacttccattttcacagttcgttgaagacaaggtaaacggcaacagctattactacccaaaaggcatttactacgtaatggactacttcaaaaccaaatacggagaccctttaatctatgtcaccgagaacggtgagttttacgaactcttttcatytataccacataataattattgtattttgatattagtcgaagaaactgactttattgtggaatatttttaatgtggcggtttatttaggatttagtacccccagtgaagaaaaccgtgagcaggctattgccgattacaagcgaattgattatctctgcagtcatttatgttttctccgcaaggtcatcaagtga

SEQ ID NO: 686 - DNA, 2379 bp, Brassica juncea
atgaagcttcttcatggactcgctttagtttttctattagctgctgcgagttgcaaagctgatgaagaaattacttgcgaagagaacaatccattcacatgtagtaacactgatattttaagcagtaaaaacttcggaaaagacttcatcttcggtgttgcatcttctgcttaccaggcatgtaacaaatttttttgacgtataaataaatacaattcaaaaatactaaaatgcaacttcgcatggttgtttcttttcatttcagatcgaaggaggaagaggtcgtggtgttaacatttgggatggcttcagtcaccgatatccaggtacgtcacagtgtatatatacacatgagatgaacgtcggtttatatgtacacatattaatgtatttgtaactactatcagagaaatcagggtcagatttgaagaatggagacactacttgtgagtcatatacgagatggcaggttaatacattgatactcatatgactgaactatatatgtataaaaactatacgtgtggattgacatgtgattaaaatatgtaaaccgcagaaagatgtagacgtgatgggcgaactcaatgctactggctacaggttctcctttgcgtggtcaagaatcattccaagtatgtacatgttatcgattcgtttgtattttaattgggatcatttagttgagaaaagtactaattaatgtacgacatatatatacatgagcagaaggaaaggtgagtaggggagtgaaccaaggaggtcttgattactaccacaaactcatagatgcacttctcgaaaagaatataacgcctttcgttaccctctttcactgggaccttcctcaaacactccaagatgagtatgaaggtttcttagaccgccagatcatgtatgtttatatttgttccatgcttcttatattataaataagagaagaaaacgttttggttttagttacatgcattaatgaaatgattctgtataatatgcacagacaagatttcaaagactacgcggatctatgtttcaaagaatttggtggaaaggtaaagcactggatcacgatcaaccagctatacacagtccctacgagaggctatgcggtcggaacagatgcacccggtcgatgttctcctatggttgataccaagcacaggtgttacggtggaaattcttcaacagaaccctacatcgttgcacataaccagcttcttgctcatgccacggtcgtcgatctttacaggaccaaatataaggtgagtggtctctccatattaaggtggtgcaaatctaacatatctgattctaatgtatagtcatatatatatatatatcacgtgaccaacagtttcaaaaagggaagattggacctgtgatgataacaagatggtttcttccatttgatgagtctgatcctgcctccatagaagcagctgagaggatgaaccaattctttcatggatggtatatatatatattacagaacaatgtaacagtatatagtgtatgtatgtataattaaaagatatacatggatcaggtacatggagccgctaacaaagggtagatacccagacatcatgaggcagattgtgggtagtaggcttcccaactttaccgaggaagaagccttactcgttgccggttcatatgattttcttggtctcaactattatgttactcagtacgcccagccaaaacctaacccatatccttcagagacacacactgccatgatggacgctggcgtaaagctcacatgtactagtctattaccactaattagatacagcctttctatacatataaatattcttttatctcctttttgttgcaacatactttgtgagtgaccatctgttatttcatccttgtgtttacagatgataactcacgtggtgaatttcttggtccactggtatatatcaatgatccaccccctaagatttgtttttctttcattttttcagttttcagtataacaaccctaattatgttttttaattgatgtgtatatttatttacttccattttcacagttcgttgaagacaaggtaaacggcaacagctattactacccaaaaggcatttactacgtaatggactacttcaaaaccaaatacggagaccctttaatctatgtcaccgagaacggtgagttttacgaactctttttatttataccacataataattattgtattttgatattagtcgaagaaactgactttattgtggaatatttttaatgtggcggtttatttaggatttagtacccccagtgaagaaaaccgtgagcaggctattgccgattacaagcgaattgattatctctgcagtcatttatgttttctccgcaaggtcatcaagtga

SEQ ID NO: 687 - DNA, 2379 bp, Brassica juncea; identical to SEQ ID NO: 686

SEQ ID NO: 688 - DNA, 2379 bp, Brassica juncea; identical to SEQ ID NO: 686

SEQ ID NO: 689 - DNA, 2414 bp, Brassica juncea
atgaagcttcttcatggactcgctttagtttttctattagctgctgcgagttgcaaagctgatgaagaaattacttgcgaagagaacaacccattcacatgtagtaacactgatattttaagcagtaagaacttcggaaaagatttcatcttcggtgttgcatcttctgcttaccaggcatgtagcaaatgttgtcacaccataattttgaaataaaatttaaaacactaaaatgcaactttgcatggttgtttcttttcatttcagattgaaggagggagaggtcgtggtgttaacgtttgggatggcttcagtcaccgatacccaggtatgtcatttgcacagcgacatctatatttatatgtgagaggaatgttggttacatatactcatatagtcatattaatgtatttgtaactactatcagagaaatcagggtcagacttgaagaatggagacactacttgtgagtcctatacgagatggcaggttaatacattgatactcgtatgattgaactatatatgtataaaaactatacgtgtggaattgacatgtgattaaaatatgtaaactgcagaaagatgtagacgtgatgggcgaactcaatgctactggctacaggttctcctttgcgtggtcaagaatcattccaagtatgtacatgttatccattcgtttgtatwttaaytgggatcatttagttgaaaaagtactaattaatgtacgacatatatatacatgagcagaaggaaaggtgagtaggggagtgaaccaaggaggtcttgattactaccacaaactcwtagatgcactcctcgaaaagaatataacgcctttcgttaccctctttcactgggaccttcctcaaacactccaagatgagtatgaaggtttcttggaccgccagatcatgtatgtgccatgcagacatattatatatgaatttaagagattgattataaaattattaataaaaaagaagaaggtttggtcttatttaattacatgtattaactgaaataattatatattcatatgcagacaagatttcaaagattacgcggatctatgtttcaaagaatttggtggaaaggtaaagcactggatcacgatcaaccagttatacacagtccctacgagaggctatgckgtcggaacagatgcacccggtcgatgttctcctatggttgataccaagcacaggtgttacggtggaaattcttcaacagaaccctacatcgttgcacataaccagcttcttgctcatgccacggtcgtcgatctttacaggaccaaatacaaggtgagttgtctcaataygtgataaagatggtgtartgtaatctaagatatctgattctaacttagtcawatatcacgtraccaacagttccaaaaagggaagattggacctgtaatgattacaagatggtttcttccatttgatgagtctgatcctgcctccatagaagcagctgagaggatgaaccaattcttccatggatggtatatatatatatttatattaccaaaaatgtatcagtataaattgtatatatgtataatgaaaagatatacatggatcaggtacatggagccgctaacaaagggtagatacccagacatcatgaggcagattgtgggtagtaggcttcccaacttcaccgaggaagaagcagaactcgttgctggttcatatgattttcttggtctaaactattacgtcacccaatacgcccagccaaaacctaacccatatccttcagagacacacactgccatgatggacgctggcgtaaagctcacatgtacttttctattaccacttagttacaaccttttgatatatataaatgttttatctcctttttgtgagtgaccatcagttatttcattcttgtggttacagatgataattcacgtggtgaatttcttggtccactggtataatatgaatgatccacccctatgatttctaattcattttattttttcaattttcaatataagcaccactaattaggttttcttgattgatatgtatacgcttaactcccgtttctcagtttgttgaagacaaagtaaacggcaacagctattactacccaaaaggcatttattacgttatggactacttcaaaaccaaatacggcgaccctttaatctatgtcaccgaaaatggtgagttctacatgcatatattttcatctataacatctactataatttgtgtatttcgaaataattccaagaaactgactttcaaatattgtgtactttttcatgttatgtcggtttaattaggatttagtacccccagttcagaaaaccgtgagcaagctattgccgactacaagcgaatcgattatctatgcagccatctatgttttctccgcaaggtgatcaagtga

SEQ ID NO: 690 - DNA, 2414 bp, Brassica juncea
atgaagcttcttcatggactcgctttagtttttctattagctgctgcgagttgcaaagctgatgaagaaattacttgcgaagagaacaacccattcacatgtagtaacactgatattttaagcagtaagaacttcggaaaagatttcatcttcggtgttgcatcttctgcttaccaggcatgtagcaaatgttgtcacaccataattttgaaataaaatttaaaacactaaaatgcaactttgcatggttgtttcttttcatttcagattgaaggagggagaggtcgtggtgttaacgtttgggatggcttcagtcaccgatacccaggtatgtcatttgcacagcgacatctatatttatatgtgagaggaatgttggttacatatactcatatagtcatattaatgtatttgtaactactatcagagaaatcagggtcagacttgaagaatggagacactacttgtgagtcctatacgagatggcaggttaatacattgatactcgtatgattgaactatatatgtataaaaactatacgtgtggaattgacatgtgattaaaatatgtaaactgcagaaagatgtagacgtgatgggcgaactcaatgctactggctacaggttctcctttgcgtggtcaagaatcattccaagtatgtacatgttatccattcgtttgtatwttaaytgggatcatttagttgaaaaagtactaattaatgtacgacatatatatacatgagcagaaggaaaggtgagtaggggagtgaaccaaggaggtcttgattactaccacaaactcwtagatgcactcctcgaaaagaatataacgcctttcgttaccctctttcactgggaccttcctcaaacactccaagatgagtatgaaggtttcttggaccgccagatcatgtatgtgccatgcagacatattatatatgaatttaagagattgattataaaattattaataaaaaagaagaaggtttggtcttatttaattacatgtattaactgaaataattatatattcatatgcagacaagatttcaaagattacgcggatctatgtttcaaagaatttggtggaaaggtaaagcactggatcacgatcaaccagytatacacagtccctackagaggctatgcrgtyggaacagatgcaccmggtcgatgttctcctatggttgataccaagcacaggtgttacggtggaaattcttcaacagaaccctacatcgttgcacataaccagcttcttgctcatgccacggtcgtcgatctttacaggaccaaatacaaggtgagttgtctcaataygtgataaagatggtgtartgtaatctaagatatctgattctaacttagtcawatatcacgtraccaacagttccaaaaagggaagattggacctgtaatgattacaagatggtttcttccatttgatgagtctgatcctgcctccatagaagcagctgagaggatgaaccaattcttccatggatggtatatatatatatttatattaccaaaaatgtatcagtataaattgtatatatgtataatgaaaagatatacatggatcaggtacatggagccgctaacaaagggtagatacccagacatcatgaggcagattgtgggtagtaggcttcccaacttcaccgaggaagaagcagaactcgttgctggttcatatgattttcttggtctaaactattacgtcacccaatacgcccagccaaaacctaacccatatccttcagagacacacactgccatgatggacgctggcgtaaagctcacatgtacttttctattaccacttagttacaaccttttgatatatataaatgttttatctcctttttgtgagtgaccatcagttatttcattcttgtggttacagatgataattcacgtggtgaatttcttggtccactggtataatatgaatgatccacccctatgatttctaattcattttattttttcaattttcaatataagcaccactaattaggttttcttgattgatatgtatacgcttaactcccgtttctcagtttgttgaagacaaagtaaacggcaacagctattactacccaaaaggcatttattacgttatggactacttcaaaaccaaatacggcgaccctttaatctatgtcaccgaaaatggtgagttctacatgcatatattttcatctataacatctactataatttgtgtatttcgaaataattccaagaaactgactttcaaatattgtgtactttttcatgttatgtcggtttaattaggatttagtacccccagttcagaaaaccgtgagcaagctattgccgactacaagcgaatcgattatctatgcagccatctatgttttctccgcaaggtsatcaagtga

SEQ ID NO: 691 - DNA, 2414 bp, Brassica juncea
atgaagcttcttcatggactcgctttagtttttctattagctgctgcgagttgcaaagctgatgaagaaattacttgcgaagagaacaacccattcacatgtagtaacactgatattttaagcagtaagaacttcggaaaagatttcatcttcggtgttgcatcttctgcttaccaggcatgtagcaaatgttgtcacaccataattttgaaataaaatttaaaacactaaaatgcaactttgcatggttgtttcttttcatttcagattgaaggagggagaggtcgtggtgttaacgtttgggatggcttcagtcaccgatacccaggtatgtcatttgcacagcgacatctatatttatatgtgagaggaatgttggttacatatactcatatagtcatattaatgtatttgtaactactatcagagaaatcagggtcagacttgaagaatggagacactacttgtgagtcctatacgagatggcaggttaatacattgatactcgtatgattgaactatatatgtataaaaactatacgtgtggaattgacatgtgattaaaatatgtaaactgcagaaagatgtagacgtgatgggcgaactcaatgctactggctacaggttctcctttgcgtggtcaagaatcattccaagtatgtacatgttatccattcgtttgtatwttaattgggatcatttagttgaaaaagtactaattaatgtacgacatatatatacatgagcagaaggaaaggtgagtaggggagtgaaccaaggaggtcttgattactaccacaaactcatagatgcactcctcgaaaagaatataacgcctttcgttaccctctttcactgggaccttcctcaaacactccaagatgagtatgaaggtttcttggaccgccagatcatgtatgtgccatgcagacatattatatatgaatttaagagattgattataaaattattaataaaaaagaagaaggtttggtcttatttaattacatgtattaactgaaataattatatattcatatgcagacaagatttcaaagattacgcggatctatgtttcaaagaatttggtggaaaggtaaagcactggatcacgatcaaccagytatacacagtccctackagaggctatgcrgtyggaacagatgcacccggtcgatgttctcctatggttgataccaagcacaggtgttacggtggaaattcttcaacagaaccctacatcgttgcacataaccagcttcttgctcatgccacggtcgtcgatctttacaggaccaaatacaaggtgagttgtctcaataygtgataaagatggtgtartgtaatctaagatatctgattctaacttagtcawatatcacgtraccaacagttccaaaaagggaagattggacctgtaatgattacaagatggtttcttccatttgatgagtctgatcctgcctccatagaagcagctgagaggatgaaccaattcttccatggatggtatatatatatatttatattaccaaaaatgtatcagtataaattgtatatatgtataatgaaaagatatacatggatcaggtacatggagccgctaacaaagggtagatacccagacatcatgaggcagattgtgggtagtaggcttcccaacttcaccgaggaagaagcagaactcgttgctggttcatatgattttcttggtctaaactattacgtcacccaatacgcccagccaaaacctaacccatatccttcagagacacacactgccatgatggacgctggcgtaaagctcacatgtacttttctattaccacttagttacaaccttttgatatatataaatgttttatctcctttttgtgagtgaccatcagttatttcattcttgtggttacagatgataattcacgtggtgaatttcttggtccactggtataatatgaatgatccacccctatgatttctaattcattttattttttcaattttcaatataagcaccactaattaggttttcttgattgatatgtatacgcttaactcccgtttctcagtttgttgaagacaaagtaaacggcaacagctattactacccaaaaggcatttattacgttatggactacttcaaaaccaaatacggcgaccctttaatctatgtcaccgaaaatggtgagttctacatgcatatattttcatctataacatctactataatttgtgtatttcgaaataattccaagaaactgactttcaaatattgtgtactttttcatgttatgtcggtttaattaggatttagtacccccagttcagaaaaccgtgagcaagctattgccgactacaagcgaatcgattatctatgcagccatctatgttttctccgcaaggtgatcaagtga

SEQ ID NO: 692 - DNA, 2459 bp, Brassica juncea
atgaagcttcttcatggactcgctttagtttttctattagctgctgcgagttgcaaagctgatgaagaaattacttgcgaagagaacaatccattcacttgtagtaacactgatattttaagcagtaagaacttcggaaaagatttcatcttcggtgttgcatcttctgcttaccaggcatgtagcaaatgttgtcacaccctaattttgaaataaaatttaaaacactaaaatgcaactttgcatggttgcctcttttcatttcagatcgaaggagggagaggtcgtggtgttaacgtttgggatggcttcagtcaccgatacccaggtatgtcgtttgcacggtgacatctattttatatgtgagaggaatgttggttacatatacacatattaatgtatttgtaatttaatatcagagaaagctgggtcagatttgaagaatggagacactacttgtgagtcatatacgagatggcaggttaatttctcagtacattgatactcatgactgaactatagtatgtataaaaactatacgtgtggattgacatgagattaaaattaatatgtaaactgcagaaagatgtagacgtgatgggcgaactcaatgctactggctacagattctcctttgcgtggtcaagaatcattccaagtatgtacatattatcgatcaattatatatatatatatatatataaatatatattattttttttaattgggatgatttagttggaagagtactaattaaagtacgatgtatatatacatgagcagaaggaaaggtgagtaggggagtgaaccaaggaggccttgattactaccacaaactcatagatgcactcctcgaaaaaaatataacgcctttcgttaccctctttcactgggatcttcctcaaacactccaagatgagtatgaaggtttcttggaccgccagatcatgtatgtgccatccttcttaattatatctgaagagagtaaatataattagtgatagaagaagaatatttggtttaatttacatgtattactgaaatgattctatactaatatgcacagmcaagatttcaaagaytacgcggatctatgtttcaaagaatttggtggaaaggtaaagcaytggatcacgatcaaccagctatacacagtgcctacaagaggctatgckatcggaacagatgcaccmggtcgatgttctcctatggttgataccaagcacaggtgttacggyggaaattcttcaacagaaccctacatcgttgcacataaccagcttcttgctcatgccacggtcgtcgatctttacaggaccaaatataaggtgagtggcctccatatgtgaaaaggtggtctaaatctaacatatccgattctaatgtatagtcatatatatatcacgtgatgaacagttccaaaaagggaagattggacctgtgatgataactagatggtttcttccatatgatgaatctgatcctgcctccatagaagcagctgagaggatgaaccaattcttccatggatggtatatataattttatatattaccaaaaatgtatcagtttgtattttatgtattataatgaaacaaaaatatacttggatcaggtatatggagccgttaacaaagggtagatacccagacatcatgaggcagattgtgggtagtcggcttcccaacttcaccgaggaagaagcggaactcgttgctggttcatatgattttcttggtctcaactattacgtcactcagtacgcccagccaaaaccgaacccatatccttcagagacacacactgccatgatggacgctggcgtaaagctcacatgtactacaacattaccacttagttacaagctttctatatacatatatatatgtgctatctcctttttgttacaacatactttctgagtgaccatcaattatttcatccttgtgtttacagatgataattcacgtggtgaatttcttggtccactggtatatataaatgatcatccacccctttgatttctctttcaatttttttttctatttgcaatataacaccactttctccttgttaatatgtatatatatgtttgcttcctttctcagttcgttgaagacaaagtcaacggcaacagctattactacccaaaagggatttattacgtaatggactacttcaaaaccaaatacggcgacccattaatctatgtcaccgagaatggcgagttctacatacttccactactcatattttcatatataacatatcgtaattagtgtatttcgaaataaatccaagaaactgattttcaaatattgtatactttttcatgttatggcggttaattaggatttagtacccccagttcagaaaaccgtgagcaagctattgccgattacaagcgaattgattatctgtgcagtcatctatgttttctccgcaaggtcatcaagtga

SEQ ID NO: 693 - DNA, 2459 bp, Brassica juncea; identical to SEQ ID NO: 76

SEQ ID NO: 694 - DNA, 2459 bp, Brassica juncea
atgaagcttcttcatggactcgctttagtttttctattagctgctgcgagttgcaaagctgatgaagaaattacttgcgaagagaacaatccattcacttgtagtaacactgatattttaagcagtaagaacttcggaaaagatttcatcttcggtgttgcatcttctgcttaccaggcatgtagcaaatgttgtcacaccctaattttgaaataaaatttaaaacactaaaatgcaactttgcatggttgcctcttttcatttcagatcgaaggagggagaggtcgtggtgttaacgtttgggatggcttcagtcaccgatacccaggtatgtcgtttgcacggtgacatctattttatatgtgagaggaatgttggttacatatacacatattaatgtatttgtaatttaatatcagagaaagctgggtcagatttgaagaatggagacactacttgtgagtcatatacgagatggcaggttaatttctcagtacattgatactcatgactgaactatagtatgtataaaaactatacgtgtggattgacatgagattaaaattaatatgtaaactgcagaaagatgtagacgtgatgggcgaactcaatgctactggctacagattctcctttgcgtggtcaagaatcattccaagtatgtacatattatcgatcaattatatatatatatatatatataaatatatattattttttttaattgggatgatttagttggaagagtactaattaaagtacgatgtatatatacatgagcagaaggaaaggtgagtaggggagtgaaccaaggaggccttgattactaccacaaactcatagatgcactcctcgaaaaaaatataacgcctttcgttaccctctttcactgggatcttcctcaaacactccaagatgagtatgaaggtttcttggaccgccagatcatgtatgtgccatccttcttaattatatctgaagagagtaaatataattagtgatagaagaagaatatttggtttaatttacatgtattactgaaatgattctatactaatatgcacagccaagatttcaaagattacgcggatctatgtttcaaagaatttggtggaaaggtaaagcattggatcacgatcaaccagctatacacagtgcctacaagaggctatgcgatcggaacagatgcacccggtcgatgttctcctatggttgataccaagcacaggtgttacggcggaaattcttcaacagaaccctacatcgttgcacataaccagcttcttgctcatgccacggtcgtcgatctttacaggaccaaatataaggtgagtggcctccatatgtgaaaaggtggtctaaatctaacatatccgattctaatgtatagtcatatatatatcacgtgatgaacagttccaaaaagggaagattggacctgtgatgataactagatggtttcttccatatgatgaatctgatcctgcctccatagaagcagctgagaggatgaaccaattcttccatggatggtatatataattttatatattaccaaaaatgtatcagtttgtattttatgtattataatgaaacaaaaatatacttggatcaggtatatggagccgttaacaaagggtagatacccagacatcatgaggcagattgtgggtagtcggcttcccaacttcaccgaggaagaagcggaactcgttgctggttcatatgattttcttggtctcaactattacgtcactcagtacgcccagccaaaaccgaacccatatccttcagagacacacactgccatgatggacgctggcgtaaagctcacatgtactacaacattaccacttagttacaagctttctatatacatatatatatgtgctatctcctttttgttacaacatactttctgagtgaccatcaattatttcatccttgtgtttacagatgataattcacgtggtgaatttcttggtccactggtatatataaatgatcatccacccctttgatttctctttcaatttttttttctatttgcaatataacaccactttctccttgttaatatgtatatatatgtttgcttcctttctcagttcgttgaagacaaagtcaacggcaacagctattactacccaaaagggatttattacgtaatggactacttcaaaaccaaatacggcgacccattaatctatgtcaccgagaatggcgagttctacatacttccactactcatattttcatatataacatatcgtaattagtgtatttcgaaataaatccaagaaactgattttcaaatattgtatactttttcatgttatggcggttaattaggatttagtacccccagttcagaaaaccgtgagcaagctattgccgattacaagcgaattgattatctgtgcagtcatctatgttttctccgcaaggtcatcaagtga

SEQ ID NO: 695 - DNA, 2484 bp, Brassica juncea; identical to SEQ ID NO: 70

SEQ ID NO: 696 - DNA, 2484 bp, Brassica juncea; identical to SEQ ID NO: 70

SEQ ID NO: 697 - DNA, 2430 bp, Brassica juncea
atgaagcttcttgggctcgctttagtttttctgttagcttctgcgagttgcaaagctgacgaagaaattacttgtgaagagaacaatccattcacatgtagtaacactgatattttaagcagtaaaaacttcggaaaagacttcatcttcggtgttgcatcttctgcttaccaggcatgtaacaaatgttgacataccatactttttgacgtatagaaaacactattcaaaaatgataatatctaactttgcatggttgtttcttttcatttcagatcgaaggagggagaggtcgtggtgttaacatttgggatggcttcagtcaccgatacccaggtatgtcgtttgcacggtgacatctatatatatcatatatgacaggaatgttggttataagtactcatattaatgtatttgtaattactatcagagaaatcagggtcagatttgaagaatggagacactacttgtgagtcatatacgagatggcaggttaattcttcagtacatttctagatactcatgactgaactatgtatacaaactacgtgccgattgagatgcaatcaaaatatgaaactgcagaaagatgtagacgttatgggcgaactaaatgctactggctacagattttcctttgcgtggtcgagaatcattccaagtacgtacagattatcgatcagtacatgtatatatatagttggacgtgttttaaatgtacgatttatatatacatgagcagaaggaaaggtgagtaggggagtgaaccaaggaggtcttgattactaccacaaactcatagacgccctcctcgaaaagaatataactcctttcgttaccctctttcactgggaccttcctcaaacactccaagatgagtacgaaggtttcttggaccgccagatcatgtatgtttatatttgtgacatgcttcttatattattaataagagaagaaaaagatggttaattttagttacatgcattactgaaatgattctatattaatatgcacagacaagatttcaaagattatgccgatctatgtttcaaagaatttggtggaaaggtaaagcactggatcacgatcaaccagctatacacagtccctacgagaggctatgcagtcggaacagatgcacccggtcgatgttctcctatggttgatactaagcacaggtgttacggcggaaattcttcaacagaaccctatatcgttgcacataaccagcttcttgctcatgccacggtcgtcgatctttacaggaccaaatataaggtgaatgctgtctccatatgtgaaaattaaggtggtgtctaacatatctgattctaatgtaaatatcacgtgaccaacagttccaaaaagggaagattggacctgtgatgataacaagatggtttcttccatttgatgagtctgatccggcctccatagaagcagctgagaggatgaaccaattcttccatggatggtatatatatatattaccaaaaatgtaacagtatctactgtatttgtatgtatgtataatggaaaaatatacatggatcaggtacatggagccgctaacaaagggtagatacccagacatcatgaggcagattgtgggtagtaggcttcccaactttaccgaggaagaagccaaactcgttgccggttcatatgattttcttggtctcaactattacgtcactcagtacgcccagccaaaacctaacccatatccttcagagacacacactgccatgatggacgctggtgtaaagctcacatgtaagtaccacacaatattactacttagttacgacctttctatatattttttttcttctttttgttaacatactttgtgagagtatcaattatttcatccttgtgtttacagatgataattcgcgtggtgaatttcttggtccactggtatatatgaatgaaccacccctatgatatctctttcattttttattctatttgcaatatatagaacaccactgattatgttctcgtgattgatatgtatatttgtttgcttcccttgctcagttcgttgaagacaaagataacggaaacagctattactatccaaaaggaatttattacgtgatggactacttcaaaaccaactacggcaaccctttaatctatgtcaccgagaacggtgagttctacatactactactcctctattttcatttataccacgcataatattatgtaaccacaaaagtagacccatattcaatctaccgcagggtgaatagtaatgaaaataattgtaaaagttattttacaattattgtattttcgaaattggtccaagaaactaacttacaaatattgtgtaatatttttcatgcaatggcggcttaattaggatttagtacgcccagttcagaaaaccgtgagcaggctattgcggattacaag

SEQ ID NO: 698 - DNA, 2484 bp, Brassica juncea
atgaagcttcttgggctcgctttagtttttctgttagcttctgcgagttgcaaagctgacgaagaaattacttgtgaagagaacaatccattcacatgtagtaacactgatattttaagcagtaaaaacttcggaaaagacttcatcttcggtgttgcatcttctgcttaccaggcatgtaacaaatgttgacataccatactttttgacgtatagaaaacactattcaaaaatgataatatctaactttgcatggttgtttcttttcatttcagatcgaaggagggagaggtcgtggtgttaacatttgggatggcttcagtcaccgatacccaggtatgtcgtttgcacggtgacatctatatatatcatatatgacaggaatgttggttataagtactcatattaatgtatttgtaattactatcagagaaatcagggtcagatttgaagaatggagacactacttgtgagtcatatacgagatggcaggttaattcttcagtacatttctagatactcatgactgaactatgtatacaaactacgtgccgattgagatgcaatcaaaatatgaaactgcagaaagatgtagacgttatgggcgaactaaatgctactggctacagattttcctttgcgtggtcgagaatcattccaagtacgtacagattatcgatcagtacatgtatatatatagttggacgtgttttaaatgtacgatttatatatacatgagcagaaggaaaggtgagtaggggagtgaaccaaggaggtcttgattactaccacaaactcatagacgccctcctcgaaaagaatataactcctttcgttaccctctttcactgggaccttcctcaaacactccaagatgagtacgaaggtttcttggaccgccagatcatgtatgtttatatttgtgacatgcttcttatattattaataagagaagaaaaagatggttaattttagttacatgcattactgaaatgattctatattaatatgcacagacaagatttcaaagattatgccgatctatgtttcaaagaatttggtggaaaggtaaagcactggatcacgatcaaccagctatacacagtccctacgagaggctatgcagtcggaacagatgcacccggtcgatgttctcctatggttgatactaagcacaggtgttacggcggaaattcttcaacagaaccctatatcgttgcacataaccagcttcttgctcatgccacggtcgtcgatctttacaggaccaaatataaggtgaatgctgtctccatatgtgaaaattaaggtggtgtctaacatatctgattctaatgtaaatatcacgtgaccaacagttccaaaaagggaagattggacctgtgatgataacaagatggtttcttccatttgatgagtctgatccggcctccatagaagcagctgagaggatgaaccaattcttccatggatggtatatatatatattaccaaaaatgtaacagtatctactgtatttgtatgtatgtataatggaaaaatatacatggatcaggtacatggagccgctaacaaagggtagatacccagacatcatgaggcagattgtgggtagtaggcttcccaactttaccgaggaagaagcccaactcgttgccggttcatatgattttcttggtctcaactattacgtcactcagtacgcccagccgaaacctaacccatatccttcagagacacacactgccatgatggacgctggtgtaaagctcacatgtaagtaccacacaatattactacttagttacgacctttctatatattttttttcttctttttgttaacatactttgtgagagtatcaattatttcatccttgtgtttacagatgataattcgcgtggtgaatttcttggtccactggtatatatgaatgaaccacccctatgatatctctttcattttttattctatttgcaatatatagaacaccactgattatgttctcgtgattgatatgtatatttgtttgcttcccttgctcagttcgttgaagacaaagataacggaaacagctattactatccaaaaggaatttattacgtgatggactacttcaaaaccaactacggcaaccctttaatctatgtcaccgagaacggtgagttctacatactactactcctctattttcatttataccacgcataatattatgtaaccacaaaagtagacccatattcaatctaccgcagggtgaatagtaatgaaaataattgtaaaagttattttacaattattgtattttcgaaattggtccaagaaactaacttacaaatattgtgtaatatttttcatgcaatggcggcttaattaggatttagtacgcccagttcagaaaaccgtgagcaggctattgcggattacaagcgaattgattatctctgcagtcatctatgttttctccgtaaggtcatcaagtaa

SEQ ID NO: 699 - DNA, 2484 bp, Brassica juncea; identical to SEQ ID NO: 698

SEQ ID NO: 700 - DNA, 2484 bp, Brassica juncea; identical to SEQ ID NO: 698

SEQ ID NO: 701 - DNA, 2502 bp, Brassica juncea
atgaagcttcttcatggacttgctttagttttcctattagctgcttcgagttgcaaagctgatgaagaaattacatgtgaagagaacactccattcacatgtggtaacactgatattttaagcagtaaaaactttggaaaagacttcatcttcggtgttgcatcttctgcttaccaggcatgtaacaaatgttgacataccatactataaataaatacaattcaaagagctaatttccaactttgcatggttgtttattttcctttcagatcgaaggagggagaggtcgtggtgttaacatttgggatggcttcagtcaccgatacccaggtatgtcgtttttgcacggtgacgtacgtgtgtatatatatatatatatataatgtacacatattaaagcatttgtaattactatcagagaaatcagggtcagatttgatgaatggagacactacttgtgagtcatatacgagatggcaggtcagtacattgatactcacatgactgaactatgtataaaaaaacctatacgtgtgattgttgacatgccattaaaatatgtaaactgcagaaagatgtagacattatgggagaactcaatgctactggctacagattctcctttgcgtggtcaagaatcattccaagtatgtacatattattgattgttcgtaattgggatcgtttagttggaaaagtactgattaatgttttggcaaaaaaaaaagtactgattaatgtacaatatatatatgtatgcacgagcagaaggaaaagtgagtaggggagtgaaccaaggaggtcttgattactaccaccaactcatagacgccctcctagaaaagaatataacgcctttcgttaccctcttccactgggaccttcctcaaacactccaagatgagtatgaaggtttcttagaccgccagatcatgtatgtttatatttttgccatgcttcttatattattaataaaagacgaaaaagatttggttttagtaacatgcattactgaaatgattatacaataatatgcacagacaagatttcaaagattacgcggatctatgtttcaatgaatttggtggaaaggtaaagcactggatcacgatcaaccagctatatacagtgccgacaagaggctatgcgagcggaacagatgcacccggtcgatgttcttatatggttgataccaagcacaggtgttacggcggaaattcttcaacagaaccctacatcgttgcacataaccagcttcttgctcatgccgcagttgtcgatctttacaggaccaaatataaggtgagtggtgctccatatgtgaaaattagggtggtgtaaatctaacatatatctgattctaatgtatagtcatatatatgtatcacgtgaccaacagttccaaaacgggaagattggacctgtgatgataacaagatggtttcttccatttgatgagtctgatcctgcttgcgtagaagcagctgagaggatgaaccaatttttccatggatggtatttatatatatatatatatatatatatatgtgtgtgtgtgtattaccaacaatgtatcagtatgtattttatgtatttataatgaaacaaaaatatacatggatgatggatcaggtacatggagccgctaacaaagggtagatacccagacatcatgaggcagatcgtgggtagtaggctccccaactttaccgaggaagaagccgcactcgttgctggttcatatgattttcttggtctcaactattacgtcactcagtacgcccagccacaacctaacccatatccttcagagacacacactgccatgatggaccctggtgtaaagctcacatgtacgtacttcagtaatattaccacttagtacttatcaaaaaaaaaaaaaattaccacttagttacaacctttctatatatgtttttctccttttgttaacatactttgtgagtgactatcaattatttcatccttgtgtttacagataataattcacgtggtgaattacttggtccactggtaatatatgaatgatccacctctacgatttctcttttttttaatcaatattttctatttgcaatagaacaccactgattatgttctcttgattgatatgtatattttgtttggttccctttctcagttcgctgaagacaaggttaacggcaacagctattactacccaaaaggaatgtattacgtaatggacttcttcaaaaccaattacagcaaccctttaatatatatcaccgagaacggtgagttctacatactacttactactcatctattctacataaattaactagtgtattttatatattagtccaggaaactgactttcaaatatcgtggaatgttttcatggtttaattaggaattagttcgcccggtacagaaaaccgttgcgaagctattgccgattacaagcgaatcgattatctctgcagtcatctctgttttctccgtaaggtcatcaggtaa

SEQ ID NO: 702 - DNA, 2502 bp, Brassica juncea; identical to SEQ ID NO: 701

SEQ ID NO: 703 - DNA, 2502 bp, Brassica juncea; identical to SEQ ID NO: 701

SEQ ID NO: 704 - DNA, 2431 bp, Brassica juncea
atgaagcttcttcatggactcgctttagtttttctattagctactacgagttgcaaagcagatgaagaaattacttgcgaagagaacaatccattcacctgtagtaacactgatatattaagcagtaagaacttcggaaaaaatttcatcttcggtgttgcatcttctgcttaccaggcatgtagcaaatgttgtcataccccacttttgaaataaattttaaagcactaaaatgcaactttgcatggttgttcttcttatttagatagaaggagggagaggtcgtggtgttaacgtttgggatggcttcagtcaccggtacccaggtatgtggtttgcacggtgacatatatatttatatgcgagaggaatgttggttacatatacacatattaatgtatttgtaactaaaatcagagaaagctgggtcagatttgaagaatggagacactacttgtgagtcatatacgagatggcaggttaatttctcagtacattaatactcatgactgaactatatatgtataaaaactatacgtgtggattgacatgagactaaaattaatatgtaaactgcagaaagatgtagacgtgatgggcgaaatcaatgctactggctacagattctcctttgcatggtcaagaatcattccaagtatgtacatatcaacgatcaatgtatatatatctttgtattttaattgggataatttagttggaaaggtactaattaatgtacgatatatatctacccgagcagaaggaaaggtgagtaggggagtgaaccaaggaggtcttcaatactaccacaaactcatagatgcactcctggaaaagaatataacgcctttcgttaccctctatcactgggaccttcctcaaacactccaagatgagtatgaaggtttcttggaccgccagatcatgtatgttccatgcttcttaattatatttgaagagagtcaatattattagtgatagaagaagatttagtctcaattacatgtattactgaaatatttctatactaatatgcacagccaagatttcaaagattacgcggatctatgtttcaaagaatttggtggaaaggtaaagcactggatcacaatcaaccagctatacacagtgcctacgagaggctatgcactcggaacagatgcacccggtcgatgttcttatatggttgataacaagcacaggtgttatggcggaaattcttcaacagaaccctatatcgttgcacataaccagcttcttgctcatgccacgatcgtcgatctttacaggaccaaatataaggtgrgtgatctccctatgtgaaaaggtggtctaaatcaaacatatccgattctaatgaatagtcatatatatatatatatatatcacgtgatgagcagttccaaaaagggaagattggacctgtgatgataactagatggtttcttccatatgatgagtctgatccttcttgcgtagaagcagctgagaggatgaaccaattcttccatggatggtatatataattttttatatagccaaaatatatcagtatgtattttatgcatttataatgatacaaaaatatacatggatgatggatcaggtacatggagccgctaacaaagggtagatacccagacatcatgaggcagattgtgggtagtaggctccccaacttcactgaagctgaagccgaactcgttgctggttcatatgattttcttggtctcaactattacgtcactcagtatgcccagccgaaacctaacccatatccttcagagacacacactgccttgatggacgctggcgtaaagctcacatgtacgtactacagtattaccacttagttacaacctttctatatatctttttctcctatttgttaacatactttgtgagtgactatcaatttatttcattcttgtgtttacagatgataattcacgtggtgaattccttggtccactggtatattaatgatccacccctatgatttctcttttatttttttctattttcaatataacaccacttatgctctctttattgacatgtatatgtgttcgcttccctttcccagttcattgaagacaaagacaacggcaacagctattactacccaaaagggatttattacgtaatggactacttcaaaaccaaatacggtgacccattaatctatgtcaccgagaatggtgagttctacatactactactcatctttttcatctataacgtatactaaataatgtatttcggaataaatcccagaaactgactttcaaatattgtgtacctttgcatgttatggcggttaggatttagcacgcccactacagaaaaccgtggcgaagctattgccgattacaagcgaattgattatctttgcagtcatctatgttttctccgtaaggtcatcaagtga

SEQ ID NO: 705 - DNA, 2431 bp, Brassica juncea
atgaagcttcttcatggactcgctttagtttttctattagctactacgagttgcaaagcagatgaagaaattacttgcgaagagaacaatccattcacctgtagtaacactgatatattaagcagtaagaacttcggaaaaaatttcatcttcggtgttgcatcttctgcttaccaggcatgtagcaaatgttgtcataccccacttttgaaataaattttaaagcactaaaatgcaactttgcatggttgttcttcttatttagatagaaggagggagaggtcgtggtgttaacgtttgggatggcttcagtcaccggtacccaggtatgtggtttgcacggtgacatatatatttatatgcgagaggaatgttggttacatatacacatattaatgtatttgtaactaaaatcagagaaagctgggtcagatttgaagaatggagacactacttgtgagtcatatacgagatggcaggttaatttctcagtacattaatactcatgactgaactatatatgtataaaaactatacgtgtggattgacatgagactaaaattaatatgtaaactgcagaaagatgtagacgtgatgggcgaaatcaatgctactggctacagattctcctttgcatggtcaagaatcattccaagtatgtacatattaacgatcaatgtatatatatctttgtattttaattgggataatttagttggaaaggtactaattaatgtacgatatatatctacccgagcagaaggaaaggtgagtaggggagtgaaccaaggaggtcttcaatactaccacaaactcatagatgcactcctggaaaagaatataacgcctttcgttaccctctatcactgggaccttcctcaaacactccaagatgagtatgaaggtttcttggaccgccagatcatgtatgttccatgcttcttaattatatttgaagagagtcaatattattagtgatagaagaagatttagtctcaattacatgtattactgaaatatttctatactaatatgcacagccaagatttcaaagattacgcggatctatgtttcaaagaatttggtggaaaggtaaagcactggatcacaatcaaccagctatacacagtgcctacgagaggctatgcactcggaacagatgcacccggtcgatgttcttatatggttgataacaagcacaggtgttatggcggaaattcttcaacagaaccctatatcgttgcacataaccagcttcttgctcatgccacgatcgtcgatctttacaggaccaaatataaggtgagtgatctccctatgtgaaaaggtggtctaaatcaaacatatccgattctaatgaatagtcatatatatatatatatatatcacgtgatgagcagttccaaaaagggaagattggacctgtgatgataactagatggtttcttccatatgatgagtctgatccttcttgcgtagaagcagctgagaggatgaaccaattcttccatggatggtatatataattttttatatagccaaaatatatcagtatgtattttatgcatttataatgatacaaaaatatacatggatgatggatcaggtacatggagccgctaacaaagggtagatacccagacatcatgaggcagattgtgggtagtaggctccccaacttcactgaagctgaagccgaactcgttgctggttcatatgattttcttggtctcaactattacgtcactcagtatgcccagccgaaacctaacccatatccttcagagacacacactgccttgatggacgctggcgtaaagctcacatgtacgtactacagtattaccacttagttacaacctttctatatatctttttctcctatttgttaacatactttgtgagtgactatcaatttatttcattcttgtgtttacagatgataattcacgtggtgaattccttggtccactggtatattaatgatccacccctatgatttctcttttatttttttctattttcaatataacaccacttatgctctctttattgacatgtatatgtgttcgcttccctttcccagttcattgaagacaaagacaacggcaacagctattactacccaaaagggatttattacgtaatggactacttcaaaaccaaatacggtgacccattaatctatgtcaccgagaatggtgagttctacatactactactcatctttttcatctataacgtatactaaataatgtatttcggaataaatcccagaaactgactttcaaatattgtgtacctttgcatgttatggcggttaggatttagcacgcccactacagaaaaccgtggcgaagctattgccgattacaagcgaattgattatctttgcagtcatctatgttttctccgtaaggtcatcaagtga

SEQ ID NO: 706 - DNA, 2431 bp, Brassica juncea; identical to SEQ ID NO: 72

SEQ ID NO: 707 - DNA, 2440 bp, Brassica juncea
atgaagcttcttcgtcgactcgctttagtttttctattagctgctgcgagttgcaaggctgatgaagaaattacttgcgaagagaacaatccatttacttgtagtaacactgatattttaagcagcaagaacttcggaaaagatttcatctttggtgttgcgtcttctgcttaccaggcatgtagcaaatgttgtcacaccctaattttgaaataaaattcaaagcaccaatatccaattttgcatagttgtttcttttcatttcagattgaaggagggagaggtcgtggtgttaatgtttgggatggtttcagtcaccggtacccaggtatgtcgttcgcacggtgacatctaaactaataatgttggttacatatacacatattaatgtatttgtaattaatattatcagagaaagctgggtcagatttgaagaatggagacactacttgtgagtcatatacgagatggcaggttaatttctgagtacactgattctcatgactgaattatatatgtataagaactccctaaaaactatacgtgtggattgacatgaaatttaaattaattgtaaactgcagaaagatgtagacgtgatgggcgaaatcaatgctactggctacagattctcctttgcatggtcaagaatcattccaagtatgtacatattaacgatcaatgtatatatatctttgtattttaattgggataatttagttggaaaggtactaattaatgtacgatatatatctacccgagcagaaggaaaggtgagtaggggagtgaaccaaggaggtcttgattattaccaccaactcatagatgcactcctcgaaaagaatataacgcctttcgtaaccctctttcactgggaccttcctcaaacactccaagatgagtatgaaggtttcttggaccgccagatcatgtaggtgccatgcttcttaattatatttgaggagagtaaatattattagtaatagaagaagaagatttagtcttaattacatgtttactgaaatgattctatactaatatgaacagccaggatttcaaagattacgcggatctatgtttcaaagaatttggtggaaaggtaaagcattggatcacgatcaaccagctatacacagttcctacaagaggctatgcagtcggaacagatgcacccggtcgatgttctcctatggttgataccaaacacaggtgttacggcggaaattcttcaacagaaccctacatcgttgcacataaccagcttcttgctcatgccgcggtcgtcgatctttacaggaccaaatataaggtgagtggtgactccatatgtgaaaattagagtggtgtaaatctgatatatatctgattctaatgtatagtcatatatttggaccaacagttccaaaacgggaagattggacctgtgatgataacaagatggtttcttccatatgatgagtctgatcctgcctgcatagaagcagctgagaggatgaaccaattcttccatggatggtatatataattttatatattatcaaaaatgtatcagtatgtattttatgtatttataatgaaacaaaaatatacatggatcaggtacatggagccgctaacgaagggtagatacccagacatcatgaggcaaattgtgggtagtaggcttcccaactttaccgaggaagaagccgcactcgttgccggttcatatgattttcttggtctcaactattatgtcactcagtacgcccggccacaacctaacccatatccttcagagacacacactgccatgatggacgctggagtaaagctcacatgtactaatttacattaccacttagttacaacctttccgtacatatatatatacacatgttctatctcctttttgttacaacatactctgtgagtggccatcaattgtttcatccttgtgtttacagatgataattcacgtggtgaaatacttggtccactggtaatatatgaatgatatccacccctatgatttctcttttatttttatttttctatctgcaatagaacaccactgattatgttctcttgattgatgtgtttgcttccctttctcagttcgctgaagacaaagttaatggcaacagctattactacccaaaaggaatttattacgtaatggactttttcaaaaccaattacagcaaccctttaatctatatcaccgagaacggtgagttctacattctacttactactcatctattctacataaaataattagtgtatttttatatatataagtccaataaactgactttcaatattgtggaatgttttcacggtttaattaggaattagttcgcccagtacagaaagccgttgtgaagctattgccgattacaagcgaattgattatctctgcagtcatctatgttttctccgtaaggtcatcaagtga

SEQ ID NO: 708 - DNA, 2440 bp, Brassica juncea; identical to SEQ ID NO: 707

SEQ ID NO: 709 - DNA, 2440 bp, Brassica juncea; identical to SEQ ID NO: 707

SEQ ID NO: 710 - DNA, 2416 bp, Brassica juncea
atgaagattcttcatggactcgctttagtttttctattagctattgcgagttgcaaagcttatgaagaaattacttgcgaacagaacgaaccattcacatgtggtaacactgatatcttaagcagtaaaaacttcggagaagacttcatcttcggtgttgcatcttctgcgtaccaggcatgcaacaaatgctgccataccatatttttgacgtatagaaaataatattcaaaaatgctaacatcaaactttgcgtggttgtttccatttcagatcgaaggagggagaggtcgtggtgttaacgtttgggatggtttcagtcaccgatacccaggtatgtcacggtggcatatatatacatataagatgaatgtcgtttatatctacacacattaatgtatttgtaattactatcagagaaatcagggtcagatttgctgaatggagacacttcttgtgagtcatatacgagatggaaggttagttcctcagtacatatacactcatatgactaaactacgtataaaatttacgtgtgaactgaattccgtttaaaatgcagaaagatgtagagattatgggagaactcaatgctactggctacagattctccttagcgtggtcaagaatcattccaagtacgaacataaatttgtatttttattgggatcctttagctggaagagtatactaattaatgtatgatataaatgagcagaaggaaaggtgagtaggggagtgaaccaaggaggtcttgattactaccaccaactcatagacgccctcctcgaaaagaatataactcctttcgttaccctctttcactgggaccttcctcaaacactccaagatgagtatgaaggttttttggatcgccagatcatgtatgtgccatgcttcttaattatatacaaattattaataaaaacaagaagaagaagaagaaggttttgtcttaattacatgctttactgaaagaatgattatatattaatatgcacagacaagatttcaaagactatgcggatctatgtttcaaagaatttggtggaaaggtaaagcactggatcacgatcaaccagctattcacagtgcctacgagaggctatgcactcggaacagatgcacccggtagatgttctcctatgattgatgagaggtgttacggcggaaactcttcaacagaaccctatattgttgcacataaccagcttctcgctcatgctgcggtcgtcgatctttacaggaccaactataaggtgagtagtctccatatttaatacgatggtgtgatcttaatccatctgattctgatctagtcatatatatcatgtgaccaacaggaccaacaagggaagattggacctgtgatgataacaagatggtttcttccatatgatgagtctgatcccgcttgcgtagaagcagctgagaggatgaaccaattcttccatggatggtatatcttttttgtttgacatcaaacaattattcttttttttgtttgtttacattaaatggttattttattatttaaaactaaaggtggtctgtataactagaatgattatattgtatgtataatgaaaaaaatatacaccgatcaggcacatggagccgctaacaaagggtagatacccagacatcatgaggcagattgtgggtagtaggcttcccaactttaccgaggaagaagccgcactcgttgccggttcatatgattttcttggtctcaactattatgttactcagtacgcccagccacaacctaacccatatccttcagagacacacactgccatgatggacgctggagtaaagctcacatgtaccactctgtttccactttgttacaacctcctttctatatatatattcctttttgttataaaacatacttaatttgtgagtgaccataagttatttcttccttgtgtttacagataataactcacgtggtgaatatcttggtccactggtaattatgcatgatccatcctcatgatatctctctcattgatatgtatattttgttctgattgatatgtattttttgtttgcttccctttcccagttcgctgaagacaaaatagccggcaacagctattactacccaaaaggaatatattacgtaatggacttcttcaaaaccaattacagcaaccctttaatctatatcaccgagaacggtgagttctacatactacttactactcatctattctacataaattaattagtgtatttttatatattagtcgaggaaactgattttcaaatattgtggaatgttttcacggtttaattaggaataagttcgcccggtacagaaaaccgttgcgaagctattgccgattccaagcgcattgattatctctgcagtcatctatgttttctccgtaaggtcatcaagtaa

SEQ ID NO: 711 - DNA, 2416 bp, Brassica juncea; identical to SEQ ID NO: 710

SEQ ID NO: 712 - DNA, 2416 bp, Brassica juncea; identical to SEQ ID NO: 710

SEQ ID NO: 713 - DNA, 2321 bp, Brassica juncea
atgaagcttcatggactagccttgataggttttctaattgctgcggcgagttgcaaagctattgaggacattaattgccaagagaacgagcctttcacatgtggaaacactgatcagttaagcagtaaaaatttcccaaaagacttcatcttcggtgttgcttctgctgcttaccaggcatgttacaaatcaacaatttttgacgtagaaaaccatttaaaatattaaatccaacgttgcatggttgtttcttattattgtaggtggaagggggcagaggacgtggtcttaacgtttgggatggcttcactcaccgatacccaggtatatcatctacatggtacatatatatataatgtccacatctcttatatatcattcgtagtaatgtatatgtttactatcagagaagggtggatccgatctcgggaatggagacactacttgtgagtcatatacaagatggcaggttaattcctcactgagtcatataggaaaatggcaggttaattccacattcctcactatatataaatgatatccgagtgtgtatgtaaactgcgcagaaagatatagacatcatggacgagctcaatgctactggctacagattctcttttgcgtggtcaagaatcattccaagtatgaacacataaacgatctatttatacaaaaaattctcgtaaattgattgtgagtgttgagaagattaaatatatgatatgtatacatgagcagaaggaaaggtgagtaggggagtgaacaaaggaggtctcgaatactaccacaaactcatagatggtctcgtcgcaaagaatataacaccttttgttaccctctatcactgggacctacctcaaacactgcaagatgagtatgaaggtttcttgaaccgcaccatcatgtatgtcatttgtgccgcgttcttagcaagaaatataagaagaaaaacatatataagtgatctcatgttaatgatttgtttctatgctatgcacagagatgactttagagattatgcggatctatgtttcaaggaatttggtggaaaggtgaagaactggatcacgattaaccagctgtacacagtgcctacgagaggctatgcaatcggaacagatgcacccggtcgatgttctccgaaggttgatgagagatgttacggcggaaattcttcaacagaaccttatatagttgcacataaccagcttcttgctcatgctgcggcggtcgatgtttacaggacaaaatataaggtgagtatatataggtttgtaaataggtgtagtctaacatatatgtcaatgttctaatcatatcatttcatttcgtatgccgtgacaaacagttccaaggagggaagatcggaccagtgatgataactagatggtttcttccatttgatgagactgataaagctagcctatatgcagctgataggatgaaagaattcttcttgggatggtacgtatttgtatgtatatgtacacaaaaatgatatgattatttatacgtatgtacatcgatcaggttcatggagccgctaacaaagggtagatacccagacatcatgagacaaattgtgggtagtcggcttcccaatttcacggaagcagaagcagaactagttgcgggttcatatgattttcttggtctcaactactacaccactcagtatgcccagccaaaacctaacccagttacatgggaaaatcacactgccatgatggacccaggcgcaaagctcacatgtaccactcagtttcctcttatagttacaacctttctatatatatatatatatatataggcttctaagtcttttaaattaagcatatatatactttgtgagtgaccactaattatttcatcattgggtttacagatacgaattcacgtggtgaaaatcttggtccactggtatatgcatgatccacccctgacccctgttacttattattttttttctttctagttgatgtgtatacgtatgcttccttttctcagttcgttaaggacgaaataaacggcgactcctattactacccaaaaggcatttattacgttatggactacttcaaaaccaaataccgtaaccctttgatctatatcactgaaaacggtgactactactcatctctttttccatattaagcaaatatgtatgtttaaaataatgtacaagttgtttatgtaccatgatggttaaattaggatttagtactcccggtgaagaaacccgtgaggaagctattgctgattccaagcggatcgattatctctgcagtcatctatgttttctccgtaaggtcatcaggtga

SEQ ID NO: 714 - DNA, 2321 bp, Brassica juncea; identical to SEQ ID NO: 713

SEQ ID NO: 715 - DNA, 2321 bp, Brassica juncea
atgaagcttcatggactagccttgataggttttctaattgctgcggcgagttgcaaagctattgaggacattaattgccaagagaacgagcctttcacatgtggaaacactgatcagttaagcagtaaaattttcccaaaagacttcattttcggtgttgcttctgctgcttaccaggcatgttacaaatcaacaatttttgacgtagaaaaccatttaaaatattaaatccaacgttgcatggttgtttcttattattgtaggtggaagggggcagaggacgtggtcttaacgtttgggatggcttcactcaccgatacccaggtatatcatctacatggtacatatatatataatgtccacatctcttatatatcattcgtagtaatgtatatgtttactatcagagaagggtggatccgatctcgggaatggagacactacttgtgagtcatatacaagatggcaggttaattcctcactgagtcatataggaaaatggcaggttaattccacattcctcactatatataaatgatatccgagtgtgtatgtaaactgcgcagaaagatatagacatcatggacgagctcaatgctactggctacagattctcttttgcgtggtcaagaatcattccaagtatgaacacataaacgatctatttatacaaaaaattctcgtaaattgattgtgagtgttgagaagattaaatatatgatatgtatacatgagcagaaggaaaggtgagtaggggagtgaacaaaggaggtctcgaatactaccacaaactcatagatggtctcgtcgcaaagaatataacaccttttgttaccctctatcactgggacctacctcaaacactgcaagatgagtatgaaggtttcttgaaccgcaccatcatgtatgtcatttgtgccgcgttcttagcaagaaatataagaagaaaaacatatataagtgatctcatgttaatgatttgtttctatgctatgcacagagatgactttagagattatgcggatctatgtttcaaggaatttggtggaaaggtgaagaactggatcacgattaaccagctgtacacagtgcctacgagaggctatgcaatcggaacagatgcacccggtcgatgttctccgaaggttgatgagagatgttacggcggaaattcttcaacagaaccttatatagttgcacataaccagcttcttgctcatgctgcggcggtcgatgtttacaggacaaaatataaggtgagtatatataggtttgtaaataggtgtagtctaacatatatgtcaatgttctaatcatatcatttcatttcgtatgccgtgacaaacagttccaaggagggaagatcggaccagtgatgataactagatggtttcttccatttgatgagactgataaagctagcctatatgcagctgataggatgaaagaattcttcttgggatggtacgtatttgtatgtatatgtacacaaaaatgatatgattatttatacgtatgtacatcgatcaggttcatggagccgctaacaaagggtagatacccagacatcatgagacaaattgtgggtagtcggcttcccaatttcacggaagcagaagcagaactagttgcgggttcatatgattttcttggtctcaactactacaccactcagtatgcccagccaaaacctaacccagttacatgggaaaatcacactgccatgatggacccaggcgcaaagctcacatgtaccactcagtttcctcttatagttacaacctttctatatatatatatatatatataggcttctaagtcttttaaattaagcrtatatatactttgtgagtgaccactaattatttcatcattgggtttacagatamgaattcacgtggtgaaaatcttggtccactggtatatgcatgatccacccctgacccctgttacttattattttttttctttctagttgatgtgtatacgtatgcttccttttctcagttcgttaaggacgaaataaacggcgactcctattactacccaaaaggcatttattacgttatggactacttcaaaaccaaataccgtaaccctttgatctatatcactgaaaacggtgactactactcatctctttttccatattaagcaaatatgtatgtttaaaataatgtacaagttgtttatgtaccatgatggttaaattaggatttagtactcccggtgaagaaacccgtgaggaagctattgctgattccaagcggatcgattatctctgcagtcatctatgttttctccgtaaggtcatcaggtga

SEQ ID NO: 716 - DNA, 2384 bp, Brassica juncea; identical to SEQ ID NO: 77

SEQ ID NO: 717 - DNA, 2384 bp, Brassica juncea; identical to SEQ ID NO: 77

SEQ ID NO: 718 - DNA, 2384 bp, Brassica juncea; identical to SEQ ID NO: 77

SEQ ID NO: 719 - DNA, 2384 bp, Brassica juncea; identical to SEQ ID NO: 78

SEQ ID NO: 720 - DNA, 2384 bp, Brassica juncea; identical to SEQ ID NO: 78

SEQ ID NO: 721 - DNA, 2384 bp, Brassica juncea; identical to SEQ ID NO: 78

SEQ ID NO: 722 - DNA, 2559 bp, Brassica juncea
atgggttcagacagtactccccaacttccagtgatctatctctcggaccaaaccctaaaaccaggaagtgagaagtgggttgaagtgaggaatgatgtccgtaaagctcttgaagactacggagctttcgaggtgtcatatgatagagtgtcagaggagctaaagcaatcggttttggaagccatgaaagagcttttcgagttaccagttgaggctaaacggaggaacgtgtctccaaaaccctacactggatactcgactcataatggtctttccgagagtttggggatccaggatgccgaggttttggagaaagttaacgaatttactcaactgctacgccctgattttgagggtaacaagagtatcaggtaaggttatgttatgtgaacagcacgatattgctcaatgtgcaagaaatcgctaagcggtaattatgtgatttaaatgagattagtgcataggcamcataccatctagacagatatttttaacaatcaacagagaaaatcgtttcatagtgtatgtctgatactctgatttgtgcataaactgcgtaggccaattttaaaacacaaggattgcttcacaaagtaacttgttcgtaaacccctgttgatttctttatcaaatatattgttcgtaagtttttgttaattgcttctatwtaaaacaagaatatttgtttcttacataatacgttcacgcgttttgtttttgttttgttcttctcttttttattaaaatgtttaaagaaatttctttttgttgaaaacagcgaaacaatccagaagttttcagagaagctagcagaattggatgtaatggtgagaagaatggttatggagagctttgggatagagaagtactttgatgaacacctcaagtcaacgaattaccgtctgcgactgatgaagtatatagcacctcctgatgttgatactaatgttgcagcgggtgctaatgrtgctggtgatggtgctaatgatgctggtgctagtgataatgccaatgttgttgctgatactagtgatattgctagtggtattgctaatgttcatattaatgatgacgccaatattggtgctamggctaatggcgacattggtgctgatgttgatgctaaaactagtgattttgctagtgttgagtctaaagcygacgttagtaccaatgttaatgctaatgctgatgccratgctaatactggtactctcagtagtgctggtgttggtgatagtgttacagctaatggtggtgctgatgatgaggagaagaaattgggtttaccttctcatactgataaaaatcttttcactgtgctttatcaataygagattgaaggtttggaggtgttaaccaaagatgaaaagtggatcagactgaaaccatctcataactctttcgttgttatggctggagattctgtatatgtaagttaacttcttctttctttttatgagatgacatgcacatgtaaaatattaaccgctcctcattatatycatgattttatagcataaatatttcataatttacttttatrttcttttmctttgaatgaaaactaagaayttttacttttatattcwaaaacctaaacccaaacgaatttttttttactgtttcatagtattatttcaaactatgaaaattcagagactatatatatatatatatatatatatatatatatatatatatatatatatatatactgatatgtgatagttacaaaagtaaatccaccttataacttttgatgtttttttattgagtatttgcttcgtaaacgttgatgatctgtgatctctttttcctttttggtaagtatgatttgtgatctcttcaaaagttttaaggtttttgatatggttgtgcatgattacataggctatctaccagaactaaattgagacagaaaacgtgttggaataatagaaagtaacccatcttttaaaattagaagtcgaggaagaaaaaactaaaagaaaaaaaaaactagcggagaaaaaggttcaattcactttccactaaggtgaccaaccaattcctctctctacaaacaaatgtcttatgattctatttgctcttgttcactctcactagtyacgagtgttaggggaccaaccaaatcttatagcaactgatgttttatttgctcttatcacttttcactacaagcgcatgtcttggcttacatcatatgtttkttttcttctgatcatgaccttgctcttracaaaaataaaagtaacagwgatttacttggtgatgtttttgtctttttgtttgcaggcacttatgaatggtagactatttcgtccttttcatcgagtgagagtaacagagaaaaagaagacaagatattcaatagcattgttctcgactccaaacgcaggctacatcatagaaccaccaaaagaacttgtggacgaaaagcatccacgagtcttcaaaccattcacttatgttgacttgatgagtttctatcacactgagggtggtcgtagagctcgttctactcttcatgcttattgcgccgtctctgaagcatga

SEQ ID NO: 723 - DNA, 2549 bp, Brassica juncea
atgggttcagacagtactccccaacttccagtgatctatctctcggaccaaaccctaaaaccaggaagtgagaagtgggttgaagtgaggaatgatgtccgtaaagctcttgaagactacggagctttcgaggtgtcatatgatagagtgtcagaggagctaaagcaatcggttttggaagccatgaaagagcttttcgagttaccagttgaggctaaacggaggaacgtgtctccaaaaccctacactggatactcgactcataatggtctttccgagagtttggggatccaggatgccgaggttttggagaaagttaacgaatttactcaactgctacgccctgattttgagggtaacaagagtatcaggtaagttatgttatgtgaacagcacgatattgctcaatgtgcaagaaatcgctaagcggtaattatgtgatttaaatgagattagtgcataggcaccataccatatagacagatatttttaacaatcaacagagaaaatcgtttcatagtgtatgtctgatttgtgcataaactgcgtaggccaattttaaaacacaaggattgcttcacaaagtaacttgttcgtaaacccctgttgatttctttatcaaatatattgttcgtaagtttttgttaattgcttctatttaaaacaagaatatttgtttcttacataatacgttcacgcgttttgtttttgttttgttcttctcttttttattgaaatgtttaaagaaatttctttttgttgaaaacagcgaaacaatccagaagttttcagagaagctagcagaattggatgtaatggtgagaagaatggttatggagagctttgggatagagaagtactttgatgaacacctcaagtcaacgaattaccgtctgcgactgatgaagtatatagcacctcctgatgttgatactaatgttgcagcgggtgctaatggtgctggtgatggtgctaatgatgctggtgctagtgataatgccaatgttgttgctgatactagtgatattgctagtggtattgctaatgttcatattaatgatgacgccaatattggtgctaaggctaatggcgacattggtgctgatgttgatgctaaaactagtgattttgctagtgttgagtctaaagctgacgttagtaccaatgttaatgctaatgctgatgccgatgctaatactggtactctcagtagtgctggtgttggtgatagtgttacagctaatggtggtgctgatgatgaggagaagaaattgggtttaccttctcatactgataaaaatcttttcactgtgctttatcaatacgagattgaaggtttggaggtgttaaccaaagatgaaaagtggatcagactgaaaccatctcataactctttcgttgttatggctggagattctgtatatgtaagttaacttcttctttctttttatgagatgacatgcacatgtaaaatattaaccgctcctcattatatccatgattttatagcataaatatttcataatttacttttatgttcttttcctttgaatgaaaactaagaatttttacttttatattctaaaacctaaacccaaacgaaattttttttactgtttcatagtattatttcaaactatgaaaattcagagactatatatatatatatatatatatatatatatatatatatatatatatatatatactgatatgtgatagttacaaaagtaaatccaccttataacttttgatgtttttttattgagtatttgcttcgtaaacgttgatgatctgtgatctctttttcctttttggtaagtatgatttgtgatctcttcaaaagttttaaggtttttgatatggttgtgcatgattacataggctatctaccagaactaaattgagacagaaaacgtgttggaataatagaaagtaacccatcttttaaaattagaagtcgaggaagaaaaaactaaaagaaaaaaaaaactagcggagaaaaaggttcaattcactttccactaaggtgaccaaccaattcctctctctacaaacaaatgtcttatgattctatttgctcttgttcactctcactagttacgagtgttaggggaccaaccaaatcttatagcaactgatgttttatttgctcttatcactttcactacaagcgcatgtcttggcttacatcatatgtttgttttcttctgatcatgaccttgctcttaacaaaaataaaagtaacagtgatttacttggtgatgtttttgtctttttgtttgcaggcacttatgaatggtagactatttcgtccttttcatcgagtgagagtaacagagaaaaagaagacaagatattcaatagcattgttctcgactccaaacgcaggctacatcatagaaccaccaaaagaacttgtggacgaaaagcatccacgagtcttcaaaccattcacttatgttgacttgatgagtttctatcacactgagggtggtcgtagagctcgttctactcttcatgcttattgcgccgtctctgaagcatga

SEQ ID NO: 724 - DNA, 2553 bp, Brassica juncea
atgggttcagacagtactccccaacttccagtgatctatctctcggaccaaaccctaaaaccaggaagtgagaagtgggttgaagtgaggaatgatgtccgtaaagctcttgaagactacggagctttcgaggtgtcatatgatagagtgtcagaggagctaaagcaatcggttttggaagccatgaaagagcttttcgagttaccagttgaggctaaacggaggaacgtgtctccaaaaccctacactggatactcgactcataatggtctttccgagagtttggggatccaggatgccgaggttttggagaaagttaacgaatttactcaactgctacgccctgattttgagggtaacaagagtatcaggtaagttatgttatgtgaacagcacgatattgctcaatgtgcaagaaatcgctaagcggtaattatgtgatttaaatgagattagtgcataggcaccataccatctagacagatatttttaacaatcaacagagaaaatcgtttcatagtgtatgtctgatactctgatttgtgcataaactgcgtaggccaattttaaaacacaaggattgcttcacaaagtaacttgttcgtaaaccctgttgatttctttatcaaatatattgttcgtaagtttttgttaattgcttctatttaaaacaagaatatttgtttcttacataatacgttcacgcgttttgtttttgttttgttcttctcttttttattaaaatgtttaaagaaatttctttttgttgaaaacagcgaaacaatccagaagttttcagagaagctagcagaattggatgtaatggtgagaagaatggttatggagagctttgggatagagaagtactttgatgaacacctcaagtcaacgaattaccgtctgcgactgatgaagtatatagcacctcctgatgttgatactaatgttgcagcgggtgctaatggtgctggtgatggtgctaatgatgctggtgctagtgataatgccaatgttgttgctgatactagtgatattgctagtggtattgctaatgttcatattaatgatgacgccaatattggtgctaaggctaatggcgacattggtgctgatgttgatgctaaaactagtgattttgctagtgttgagtctaaagctgacgttagtaccaatgttaatgctaatgctgatgccgatgctaatactggtactctcagtagtgctggtgttggtgatagtgttacagctaatggtggtgctgatgatgagaagaaattgggtttaccttctcatactgataaaaatcttttcactgtgctttatcaatacgagattgaaggtttggaggtgttaaccaaagatgaaaagtggatcagactgaaaccatctcataactctttcgttgttatggctggagattctgtatatgtaagttaacttcttctttctttttatgagatgacatgcacatgtaaaatattaaccgctcctcattatatccatgattttatagcataaatatttcataatttacttttatattcttttcctttgaatgaaaactaagaacttttacttttatattcaaaaacctaaacccaaacgaatttttttttactgtttcatagtattatttcaaactatgaaaattcagagactatatatatatatatatatatatatatatatatatatatatatatatatatatactgatatgtgatagttacaaaagtaaatccaccttataacttttgatgtttttttattgagtatttgcttcgtaaacgttgatgatctgtgatctctttttcctttttggtaagtatgatttgtgatctcttcaaaagttttaaggtttttgatatggttgtgcatgattacataggctatctaccagaactaaattgagacagaaaacgtgttggaataatagaaagtaacccatcttttaaaattagaagtcgaggaagaaaaaactaaaagaaaaaaaaaactagcggagaaaaaggttcaattcactttccactaaggtgaccaaccaattcctctctctacaaacaaatgtcttatgattctatttgctcttgttcactctcactagttacgagtgttaggggaccaaccaaatcttatagcaactgatgttttatttgctcttatcactttcactacaagcgcatgtcttggcttacatcatatgtttgttttcttctgatcatgaccttgctcttaacaaaaataaaagtaacagagatttacttggtgatgtttttgtctttttgtttgcaggcacttatgaatggtagactatttcgtccttttcatcgagtgagagtaacagagaaaaagaagacaagatattcaatagcattgttctcgactccaaacgcaggctacatcatagaaccaccaaaagaacttgtggacgaaaagcatccacgagtcttcaaaccattcacttatgttgacttgatgagtttctatcacactgagggtggtcgtagagctcgttctactcttcatgcttattgcgccgtctctgaagcatga

SEQ ID NO: 725 - DNA, 5605 bp, Brassica juncea
atgggttcagacagtactcctcaacttccagtcatccatctctcggaccaaaccctaaaaccaggaagtgagaagtgggttgaagtgaggagtgatgtccgtaaagctcttgaagactacggcgcgttcgaggtgtcatatgatagagtgtcagaggagcttaaggaatcggttttggaagccatgaaagagcttttccagctacctgttgaggccaaaagaagaaacgtgtctcccaaaccctacactggatatatgactcataatggtatttccgagagtctggggatccaggatgccaatgttttggagaaagttaacgaatttactcaactgctacgccctgattgtgagggtaacaagagtaccaggtccgtattgttatgaacttcatagagtaaaagggaaaattaatctcttagataacaaaaaaaaaaattgtaacaaaaaaacacccaattagaaccttaaactagcactaattaagagataaaataactaaattactccaaaccctaaacccttactctaatcacattttctaaatattaaaccttaaactataatcactaaactctaaactgtaaattctaatcactaaacccaaacacaaatataaaataaaaagaactaaaacttttaattaatgatattttgaaaaaaatttcccttactattttctatcaaaaagattagggctgttcaatatggtaaaaccgaaccgtaccgaaccgaaccgaaccgaaatagacaatatggtttggttttggtatatactatataaaccgaatggatataattttataaaaaycgtaggatttggatatggtttggtatataactgattaaaccgaataaaccgaacaaaaccgattaaaagtagaaacatgtaaatatgtatctattttataacaatacatgaaaatctatttgttacataagttaaatttgtgttaataactattaccataattttatagtaataaaaaaccttaatttgtaaaacacttgaaatataactaaataaccatacatcgcaattcagacatcttattttctaagtttttcttgatatttttgctttattttagtctttactaaattaatatgaagattataaatttgagggacaataattaatggaaaattttcaattgaaaaagcatgactttaatgaacactaaatatagaagagtgaaaaaacttttctttcatgtttctattttgtttcatatttttattttcaaaatttcaaattttgattttagttatagattttattattttatttgatggtagaagcatttttacttttttgttcatttatttgaacatgtaatatatttttaataaaggattgtgttaagaatatgactctaaaattcatataatctagattttgacccgcgcaggcgcgcgggtgtatattttgaaaaatatgtgatatttgtttttcatgtaattattaggattggaaaaatgaatccgaggaacataaccgataccgatccaaagatatagtaccaaacccaaacataaattgattaaatattctaattattcaaaattttgttatttagagaaccgaatctgatccgaaccgaagtatttgggtatccgaatttatctaaaaatagatttatatacttatatatattaatatttttagatttaacgtatataaaacatcaaaaatgatacttttaaattggtttaaatacttgaaaatatatatagatagtcaaaagtaaatatctgaaatagttaaagtatactcaaatcaccaaaaatacttaaaataattattgatttcgtatccaaaattttaaatcaagccaattgatatgttaagcttaagtattatgacatatgttattcaaatttatacgtaatatattattttatttataacatttgagaaatttaaaatatataatgatttaagactttaaaaataatttaaattagttatccaaacccaaaccaaacccgcaaagatccaaatcgaactcaaaccaaaatttagaaacattctaataaggctgaaatctttgaccccgaaaactcaaaatacaaaccgatcagaactaaacccgtatgggtatcaaaagcccatccctagtcattattatatatcgtattttatcatcatataattaatcgtattttatatgtaccatcatataagtaatcatataattaatagtattttatacataccatcatataaataattacatatattatatttttaaaacttaatatgaaatatgaaaaccataatttgagttggtatttcaaattgggctttgtattatatttttcttatatatattgacaatatttttttataatggttattgaaaaatagtttagtaaaaatccatttttgaatatatgtatatttttgaatcaatttttgatataaatcaaatttgaattattattttgatttgaaatatgtatataaagtttaaattttgttttatggttagtttagaaaaaaaaattttagggaattagattgacccattttggtatattttaaaagtggcctagataactttcaattttttaaaaaaacataagcccattacttttttttcttaatactactatccttgttttcaaacaaaaatattttttttaaaagactgcaatccatgtttccaaacactccaaatttttaaaagtcctattcaagtctccaaacactccaattttgtacttgagttttaataagatagatgatctcaaacaaaataattatgttttttggtataaaaccgaataaaccgaaaaccgacggtatataaaccgaaccgaaccgaagtaaatatggatttagaatggtaatcatattttactaaccgaaataccgaaaaccgaaaaaaaccgaaccgaaaccgaaccgatatccggattgaacacccctaaaaaagatgttttagtgatatctttgggtatttctggaaagtaaattgtacgtaaattcttgttagtattatcgaatatattgttcctaggatttcgttaatttcttctagttagagcatgttatatatttttccgctcaaaatagtattatttgtgtagttcagacaagtgacaatttttttttctgtctacatagaaaacttgatttttatatattgttccgtagagaaaatgctagttcactcagatatgaaaccaatgacttaaattttttaatttcatagtatacgttcttgcgtttttgttttgttgttttcttctcttgtatctattcaaattgctcaaagaaatttctgtcttgaaaacagcgaaaggatacataagttttcagagaagatggcagaattggatgtaatggtgagaagaatggtatttgagagctttgggatagaggattactttgatgagaacctcaagtcaatgaattaccgtctacgactgatgaagtattcagcaccacgtgatgttgatacgaatgttgcggcaggtgctaatgatgctggtgatgctgctaatacgaataacaatggtaatactggtgcggatgttggtgctggcgattcagccagtactggtgacaatgacaaggttgttgctagtgatgatgctaatgctggtgctgatactaatgatattgttgttggtattgctaacgttcatattgatgatgatgctaatgatgttgctaaagctaatggcgacgttggtgctggtgttgatgctaatactaatgattgtgctagtgttaagtctagcgccgacgttgataatgttaatgctaatgtcagtgttggtactaatggtgatactaatgctaatgttggcgctgatattgaggagaagaaattaggcttaccttctcatactgataaaaaccttttgacagtactttatcaatatgagattgaaggtttggaggtgttaaccaaagatgaaaagtggatcagagtgaagccatctcataacactttcgttgttatcgctggagattctctacatgtaagttaactcctttttaaatggcatgcatgcataaaatattaactcctcatattaatcaagattttatgacatacttatggaataatttaccctttaatattctaaattaatcaagccaaatcttttttactgtttcgtagtattatttgaaaactattgaaattcagagcctatacatacagatattaattgatatgtacatagttacaaaagtaaatacaccttatcgattttgatgttatttgctttctaaacattgatgattgccgacaaaaaaaaacattgatgatttgtgatctgtccaaaagttttaaggttttgctataattgtgcacgaattgatcatctagccttcaaaaaaaaaacatagattatctaaactaactgaattacagatagagaaattaaagtattatagtaatggaatgtaactaaattagtggaagaaaaaaaagaaaaatattatttaattcacgttcactctttctctacgaactaatattttatgatttcatacttttatgtgctcatgtttactctctcattcacaggggccaggagaccaaccaaacatataacaatattaaaactataaacgtatctctattttttcttataatataattttgtaaatagaaacaaatttttactctaatatatttttctataataaaaaaatattatattttcatactttagaaatactgttttcatctctatatttaaaaataataaatagcatttccttattgtagagaaaatatagcatctatatactaaagatgaacgcatttgagtaaaaattcattgttatttttaaaaaattatattataaatttttttttaaaaacattaacatcaaaattttctcagaatttatcaacattaaaatagccaaaagaataaaaatagaaaaaaagaatgtgggaaagaaagaaaaaatgtaagaaaaaaaactttctttgaaaaaactatgagagacacaaatcacatgtgtcagtatgtaagtattcatatttattctatgtttaaaatttaattatataataaaattatactgctgacaaaaaaagtatactaatattaaaaattgagatatacaccttaaaaattataccaatgatgatcgctctaatgtcttatgatttatttgctcttgtcactttcactttcagtccagttagacaattagtgcatgtctatacaccatgttttgcttactttctatttgacgaagttaattatttcatttttaatgtttattttcttctgatcatgatcttggtgttacacaaaaataagtactaatgatgtacttggcgatgtatatgttttttgattgcaggcacttatgaatggtagactatttctcccgtttcatcgagtaagagtgacggagaaaaagaagacaagatattcaataggattgttctcgactccaaatagagattacatcatagaaccaccaaaggaacttgtggacgagcagcatccacgtgtattcaaaccattaacttacgttgacttaatgagcttctatcacactgaggttggccgtagagctcgatctactctgcatgcctattgtgccgtctccggagcttaa

SEQ ID NO: 726 - DNA, 5605 bp, Brassica juncea; identical to SEQ ID NO: 725

SEQ ID NO: 727 - DNA, 5605 bp, Brassica juncea
atgggttcagacagtactcctcaacttccagtcatccatctctcggaccaaaccctaaaaccaggaagtgagaagtgggttgaagtgaggagtgatgtccgtaaagctcttgaagactacggcgcgttcgaggtgtcatatgatagagtgtcagaggagcttaaggaatcggttttggaagccatgaaagagcttttccagctacctgttgaggccaaaagaagaaacgtgtctcccaaaccctacactggatatatgactcataatggtatttccgagagtctggggatccaggatgccaatgttttggagaaagttaacgaatttactcaactgctacgccctgattgtgagggtaacaagagtaccaggtccgtattgttatgaacttcatagagtaaaagggaaaattaatctcttagataacaaaaaaaaaaattgtaacaaaaaaacacccaattagaaccttaaactagcactaattaagagataaaataactaaattactccaaaccctaaacccttactctaatcacattttctaaatattaaaccttaaactataatcactaaactctaaactgtaaattctaatcactaaacccaaacacaaatataaaataaaaagaactaaaacttttaattaatgatattttgaaaaaaatttcccttactattttctatcaaaaagattagggctgttcaatatggtaaaaccgaaccgtaccgaaccgaaccgaaccgaaatagacaatatggtttggttttggtatataccatataaaccgaatggatataattttataaaaaccgtaggatttggatatggtttggtatataaccgattaaaccgaataaaccgaacaaaaccgattaaaagtagaaacatgtaaatatgtatctattttataacaatacatgaaaatctatttgttacataagttaaatttgtgttaataactattaccataattttatagtaataaaaaaccttaatttgtaaaacacttgaaatataactaaataaccatacatcgcaattcagacatcttattttctaagtttttcttgatatttttgctttattttagtctttactaaattaatatgaagattataaatttgagggacaataattaatggaaaattttcaattgaaaaagcatgactttaatgaacactaaatatagaagagtgaaaaaacttttctttcatgtttctattttgtttcatatttttattttcaaaatttcaaattttgattttagttatagattttattattttatttgatggtagaagcatttttacttttttgttcatttatttgaacatgtaatatatttttaataaaggattgtgttaagaatatgactctaaaattcatataatctagattttgacccgcgcaggcgcgcgggtgtatattttgaaaaatatgtgatatttgtttttcatgtaattattaggattggaaaaatgaatccgaggaacataaccgataccgatccaaagatatagtaccaaacccaaacataaattgattaaatattctaattattcaaaattttgttatttagagaaccgaatctgatccgaaccgaagtatttgggtatccgaatttatctaaaaatagatttatatacttatatatattaatatttttagatttaacgtatataaaacatcaaaaatgatacttttaaattggtttaaatacttgaaaatatatatagatagtcaaaagtaaatatctgaaatagttaaagtatactcaaatcaccaaaaatacttaaaataattattgatttcgtatccaaaattttaaatcaagccaattgatatgttaagcttaagtattatgacatatgttattcaaatttatacgtaatatattattttatttataacatttgagaaatttaaaatatataatgatttaagactttaaaaataatttaaattagttatccaaacccaaaccaaacccgcaaagatccaaatcgaactcaaaccaaaatttagaaacattctaataaggctgaaatctttgaccccgaaaactcaaaatacaaaccgatcagaactaaacccgtatgggtatcaaaagcccatccctagtcattattatatatcgtattttatcatcatataattaatcgtattttatatgtaccatcatataagtaatcatataattaatagtattttatacataccatcatataaataattacatatattatatttttaaaacttaatatgaaatatgaaaaccataatttgagttggtatttcaaattgggctttgtattatatttttcttatatatattgacaatatttttttataatggttattgaaaaatagtttagtaaaaatccatttttgaatatatgtatatttttgaatcaatttttgatataaatcaaatttgaattattattttgatttgaaatatgtatataaagtttaaattttgttttatggttagtttagaaaaaaaaattttagggaattagattgacccattttggtatattttaaaagtggcctagataactttcaattttttaaaaaaacataagcccattacttttttttcttaatactactatccttgttttcaaacaaaaatattttttttaaaagactgcaatccatgtttccaaacactccaaatttttaaaagtcctattcaagtctccaaacactccaattttgtacttgagttttaataagatagatgatctcaaacaaaataattatgttttttggtataaaaccgaataaaccgaaaaccgacggtatataaaccgaaccgaaccgaagtaaatatggatttagaatggtaatcatattttactaaccgaaataccgaaaaccgaaaaaaaccgaaccgaaaccgaaccgatatccggattgaacacccctaaaaaagatgttttagtgatatctttgggtatttctggaaagtaaattgtacgtaaattcttgttagtattatcgaatatattgttcctaggatttcgttaatttcttctagttagagcatgttatatatttttccgctcaaaatagtattatttgtgtagttcagacaagtgacaatttttttttctgtctacatagaaaacttgatttttatatattgttccgtagagaaaatgctagttcactcagatatgaaaccaatgacttaaattttttaatttcatagtatacgttcttgcgtttttgttttgttgttttcttctcttgtatctattcaaattgctcaaagaaatttctgtcttgaaaacagcgaaaggatacataagttttcagagaagatggcagaattggatgtaatggtgagaagaatggtatttgagagctttgggatagaggattactttgatgagaacctcaagtcaatgaattaccgtctacgactgatgaagtattcagcaccacgtgatgttgatacgaatgttgcggcaggtgctaatgatgctggtgatgctgctaatacgaataacaatggtaatactggtgcggatgttggtgctggcgattcagccagtactggtgacaatgacaaggttgttgctagtgatgatgctaatgctggtgctgatactaatgatattgttgttggtattgctaacgttcatattgatgatgatgctaatgatgttgctaaagctaatggcgacgttggtgctggtgttgatgctaatactaatgattgtgctagtgttaagtctagcgccgacgttgataatgttaatgctaatgtcagtgttggtactaatggtgatactaatgctaatgttggcgctgatattgaggagaagaaattaggcttaccttctcatactgataaaaaccttttgacagtactttatcaatatgagattgaaggtttggaggtgttaaccaaagatgaaaagtggatcagagtgaagccatctcataacactttcgttgttatcgctggagattctctacatgtaagttaactcctttttaaatggcatgcatgcataaaatattaactcctcatattaatcaagattttatgacatacttatggaataatttaccctttaatattctaaattaatcaagccaaatcttttttactgtttcgtagtattatttgaaaactattgaaattcagagcctatacatacagatattaattgatatgtacatagttacaaaagtaaatacaccttatcgattttgatgttatttgctttcaaaacattgatgattgccgacaaaaaaaaacattgatgatttgtgatctgtccaaaagttttaaggttttgctataattgtgcacgaattgatcatctagccttcaaaaaaaaaacatagattatctaaactaactgaattacagatagagaaattaaagtattatagtaatggaatgtaactaaattagtggaagaaaaaaaagaaaaatattatttaattcacgttcactctttctctacgaactaatattttatgatttcatacttttatgtgctcatgtttactctctcattcacaggggccaggagaccaaccaaacatataacaatattaaaactataaacgtatctctattttttcttataatataattttgtaaatagaaacaaatttttactctaatatatttttctataataaaaaaatattatattttcatactttagaaatactgttttcatctctatatttaaaaataataaatagcatttccttattgtagagaaaatatagcatctatatactaaagatgaacgcatttgagtaaaaattcattgttatttttaaaaaattatattataaatttttttttaaaaacattaacatcaaaattttctcagaatttatcaacattaaaatagccaaaagaataaaaatagaaaaaaagaatgtgggaaagaaagaaaaaatgtaagaaaaaaaactttctttgaaaaaactatgagagacacaaatcacatgtgtcagtatgtaagtattcatatttattctatgtttaaaatttaattatataataaaattatactgctgacaaaaaaagtatactaatattaaaaattgagatatacaccttaaaaattataccaatgatgatcgctctaatgtcttatgatttatttgctcttgtcactttcactttcagtccagttagacaattagtgcatgtctatacaccatgttttgcttactttctatttgacgaagttaattatttcatttttaatgtttattttcttctgatcatgatcttggtgttacacaaaaataagtactaatgatgtacttggcgatgtatatgttttttgattgcaggcacttatgaatggtagactatttctcccgtttcatcgagtaagagtgacggagaaaaagaagacaagatattcaataggattgttctcgactccaaatagagattacatcatagaaccaccaaaggaacttgtggacgagcagcatccacgtgtattcaaaccattaacttacgttgacttaatgagcttctatcacactgaggttggccgtagagctcgatctactctgcatgcctattgtgccgtctccggagcttaa

SEQ ID NO: 728 - DNA, 1781 bp, Brassica juncea; identical to SEQ ID NO: 120

SEQ ID NO: 729 - DNA, 1781 bp, Brassica juncea; identical to SEQ ID NO: 120

SEQ ID NO: 730 - DNA, 1781 bp, Brassica juncea
atgggtgcagacactcctcaacttccagtcatctatctctcggaccaaaccctaaaaccaggaagtgagaagtgggttgaagtgaggagtgatgtccgtaaagctcttgaagactacggcggttttgaggtgtcatatgatagagtgtcagaggagctgaagaagtcagttttggatgccatgatagagcttttcgagttaccagttgaggctaaacagagaaacgtgtctccgaaaccgtacactggatattcaactcataatggtctctctgagagtctagggatccagaattccaatgttttggagaaagttaacgaatttactcaactgctacgccctgattgtgagggtaacaagagtatgaggtaacgtcatgtcaaaaaaaaaaaactaagtaatgcttcgtagagtatattgttcgtaaactcctgttattttttaatcaaaaatattttcgtaatttttttgttagttgcttttataagctatgtaacaattttctatataaaaccttgtttttatttttattttttttggaaaaatgtcagttcacttatatagtaatgaactgaaaatttgttttcaatctcacgtttctcgcattttattttcttgtttctattaaaatagctatataattttctttgtgttgaaaacagcgaaacgatccagaatttttcagagaagttagcagaattggatgtaatggtgagaagaatggtcatagagagctttgggatagaaaactactttgatgaacacctcaagtcaacgaattaccgtttgcgactgatgaaatatgtagcaccacctgatgttgatgctaatgttgcggttggtactaaagattctgatgatggtgctaatacgaatacaactgctaacgctgatgctgatgatattgctaatggtattgctaaagttcatattgatgacgatgctgatgccaagggtgacgtttgcactggtgctggtaccaatcataatggtgatgacgttaatactggtgattgtgctaatgttaagtctaatgtcgacgttggtactaatgttagtgctaaatctagtgttggtgctgatgttaacactggcactattgatgatgttaatgctaatgctggtactcgtagtagtgctaatgttggcgttagtgatagtgttaaagctaatggtggcgcagatgatgaggagaagaaattaggtctaccttctcatactgataaaaaccttttgacggtactttatcaatatgagattgaaggtttggaggtgttaaccaaagatgaaaagtggatcaggttaaaaccatctcataactctttcgttgttatggctggagattctctatatgtaagttctaacttattttatttttaaatgggatgcacctttttattttttcctatcactttcacaaatgcatgtcttttctttactaaagtgtttatacattaacattatatgttttcttctcatcatgaaacttgttttgatttttgtattatttttgtttgcaggcacttatgaatggtagactgtctcgtccgtttcatagagtaagagtaacggaaagaaagaagacaaggtattcaatagcattgttctcgactccaaacggagattacatcatcgaaccaccaaaagagcttgtggacgagaagcacccacgtctcttcaaaccattcacttacgttgacttgatgagtttctatcacactgaggctggtcgtagagctcgttctactcttcacgcttattgtgccgtctctggagcataa

SEQ ID NO: 731 - DNA, 4059 bp, Brassica juncea
atgggttcagacagtactcctcaacttccagtgatctatctctcggaccaaaccctaaaaccaggaagtgagaagtgggttgaagtgaggagtgatgtccgtaaagctcttgaagactacggcgctttcgaggtgtcatatgatagagtgtcagaggagcttaaggaatcggttttggaagccatgaaagagcttttcgacttaccagttgaggctaagcagagaaacgtgtctccaaaaccctacactggatattctactcataatggtctctccgagagtctagggatccaggatgctgaggttttggagaaagttaacgagtttactcaactgctacgtcctgattgtgagggtaacaagagtatcaggtaaggttatgttatgtgaaaagaacaatattgcttatgatgtgcaggaaatcgttaagcggtaattaagcgatgtaaatggaactagttcctaggcgtcatatagaccaatatttttaacaatcgatatagaaaatcattcgtagtctatggctgattttccgtatagactacctagaccgagttttacaacacaactagattttgacccgcaaatccttgtggatattttctcattttataaatgtatagttttgatatatcctaagttttctagttttttttgtcatcaaaatgttgtaaatatatgatttatattttaatattatatattttgtaactctataatcttattggttaagttttttattcgacattattcatatataatgatttgctttatacattttacatttgttatataattttattatttttcaatcgttcataaataaattcataatttgaaataatcaaatagagaatctccttcaattttatatattgcatgcataatatcattttaaaattttatttagttatactatagaaatgatatattgtttaggataatttatattatcatattgtgtttaaaaaatatactttaacatatattattttagtatttactgcagatttataagtaaatacattgtttaatttaaagtaattaacacgtattattttaataaattttatacatagagccatctatcatacttatcttgtaattttattcgtatatgatatattttggatgtttatgatattaattttttgattaattaaattaagacttcaaaatattagattactttaatttttataacatagtttgttttttcgtgttacatttcaaaaagttattctttattatctatgattataccttcagaaaaatttaaaacattatcattttaagtttgcatacttattttttaaattttatattttgtcaaattgtttggaaaattacacaactatatttgaggtgggagattatatgatttttgaaatttgtttgttgctaaattaatacattatttttatataaataatattaatttggtaagattattttcttaaatattttttataatttaatgtaaaattaaaatttctatttaaatttgatttttcgttaaattttagaatgaattattaaaatttcatagttttctaataacatatttttaaatagttatgactaaagttattatttattatattgataaacattataaaaatatattgttgggagtttcaaaataaataaaaggatatatatgttgagatataaaattttaacactatgttaataaatttatttttgtataaaatattattagttagatgttaaccattttaatgataatgataatttattaaatgaaataatttaataaaaacttaattactatgaatataattgtcatatttaattcactatctcaattcatttttatataatacataatataatatagaatactataaaataatcgtataaatttatattttcttttgttttatgaataaaattttattaacattagatttgtaactaatattttattactaattacgaaattaattaatatgttattttataaaaatatttaaatttagtaagattttgttacattctttttcaagatattttaaaattcaattttatagttggtttattattaatgtaaataatcaaatatgtcacattacctaatttataaatggtcctactatgatttgtttatgatagataaaatataggaccctaaattaatagattagattattgcttcacaatgtaacctgttcgtaaatcttgttgatttctttaccaaatatattgttcgtaagtttttgctaattgcttctatttaaagcaataatttttgtttcttatagtatgttctcacgttttgtttttgtcttttttctcttttttaaaagtgtttaaagcaatttctttgtgttgaaaacagcgaaacaatccagaagttttcagagaagttagcagaattggatgtaatggtgagaagaatggttatggagagctttgggatagagaagtactttgatgaacacctcaagtcaacaaattaccgtctgcgactgatgaagtatatagcaccacctgaagttgatactaatgttgcggtgggtgctaatgatgctggtgatggtgctaatgatgcaagtgctagtgataaggccaatgttgttgctggggatgaagataatgttggtgctgatactagtgatattgctaatggtatagctaatgttcatattgatgatgacgctaaggctaatggcgacattggtgctgatgttgatgctaaaactagtgattgtgctaatgttgagtctaaagccgatgttagtaccgatgttaatgccaattctgattccaatgctaatactggtactcttagtagtgctagtgttggtgatattgttaaagctaatggtggtgctgatgatgaggagaagaaattaggtttaccttctcatactgataaaaatcttttcacggtgctttatcaatatgagattgaaggtttggaggtgttaaccaaagatgaaaagtggataagattgaaaccatctcataactctttcgttgttatggctggagattccgcatatgtaagttaacttcttctcctttttttaagacgacatgcagacgtaaaatattaacattcaccattgcattcatgattctatgtcccataatttacttttatattatttttaatgaaaaataagaatttttacttttatattataaaaaaaatcaaactaaattgtttttactgtttcattgtattatttgaaactattaaaattcagagcctatatatatatatatatatatatatataacatttgatgtaattttctttctacacgttgatgatttgagatctctccaaaagttttaatgtttgatatggttatgcatgattacatagtctatctactagaactaaattgagacagagaaagtgttggaataatagaaagtaatccatcttttaaaattagaagtcgaggaagaaaaaacttttttaaaaaactagtggagaaaagaaaaagatgatttcaattcacttttactaaggtgaccaaccaaatttgctctcgacaaactaatttcttatgattctaattcctcttgttcactctcactagtcactagggttagggaccaaccaaatcttatagcaactaatgtttttttttgctcttatcgctttcgctagcaagcgtatatgtcttggcaatacaccatgtgtttcttttctcctgatcatgacctttctcttaacaaaggataaagtaacaattttaccaaaaaaaaggataaagtaacgatgatgtacctggtgattttttgtcattttgtttgcaggcacttatgaatggtagactttttcgtccgtttcatcgagtaagagtaacggagaaaaagaagacaagatattcaatagcattattctcaactccaaacgcaggtaacatcatagaaccaccaaaagaacttgtggacgagaagcatccacgagtcttcaaaccattcacttatgttgacttgatgagtttctatcacactgaggctggtcgtagagctcgatctactcttcatgcttattgtgccgtctccgaagcatga

SEQ ID NO: 732 - DNA, 4057 bp, Brassica juncea
atgggttcagacagtactcctcaacttccagtgatctatctctcggaccaaaccctaaaaccaggaagtgagaagtgggttgaagtgaggagtgatgtccgtaaagctcttgaagactacggcgctttcgaggtgtcatatgatagagtgtcagaggagcttaaggaatcggttttggaagccatgaaagagcttttcgacttaccagttgaggctaagcagagaaacgtgtctccaaaaccctacactggatattctactcataatggtctctccgagagtctagggatccaggatgctgaggttttggagaaagttaacgagtttactcaactgctacgtcctgattgtgagggtaacaagagtatcaggtaaggttatgttatgtgaaaagaacaatattgcttatgatgtgcaggaaatcgttaagcggtaattaagcgatgtaaatggaactagttcctaggcgtcatatagaccaatatttttaacaatcgatatagaaaatcattcgtagtctatggctgattttccgtatagactacctagaccgagttttacaacacaactagattttgacccgcaaatccttgtggatattttcattttataaatgtataattttgatatatcctaagttttctagttttttttgtcatcaaaatgttgtaaatatatgatttatattttaatattatatattttgtaactctataatcttattggttaagttttttattcgacattattcatatataatgatttgctttatacattttacatttgttatataattttattatttttcaatcgttcataaataaattcataatttgaaataatcaaatagagaatctccttcaattttatatattgcatgcataatatcattttaaaattttatttagttatactatagaaatgatatattgtttaggataatttatattatcatattgtgtttaaaaaatatactttaacatatattattttagtatttactgcagatttataagtaaatacattgtttaatttaaagtaattaacacgtattattttaataaattttatacatagagccatctatcatacttatcttgtaattttattcgtatatgatatattttggatgtttatgatattaattttttgattaattaaattaagacttcaaaatattagattactttaatttttataacatagtttgttttttcgtgttacatttcaaaaagttattctttattatctatgattataccttcagaaaaatttaaaacattatcattttaagtttgcatacttattttttaaattttatattttgtcaaattgtttggaaaattacacaactatatttgaggtgggagattatatgatttttgaaatttgtttgttgctaaattaatacattatttttatataaataatattaatttggtaagattattttcttaaatattttttataatttaatgtaaaattaaaatttctatttaaatttgatttttcgttaaattttagaatgaattattaaaatttcatagttttctaataacatatttttaaatagttatgactaaagttattatttattatattgataaacattataaaaatatattgttgggagtttcaaaataaataaaaggatatatatgttgagatataaaattttaacactatgttaataaatttatttttgtataaaatattattagttagatgttaaccattttaatgataatgataatttattaaatgaaataatttaataaaaacttaattactatgaatataattgtcatatttaattcactatctcaattcatttttatataatacataatataatatagaatactataaaataatcgtataaatttatattttcttttgttttatgaataaaattttattaacattagatttgtaactaatattttattactaattacgaaattaattaatatgttattttataaaaatatttaaatttagtaggattttgttagattctttttcaagatattttaaaattcaattttatagttggtttattattaatgtaaataatcaaatatgtcacattacctaatttataaatggtcctactatgatttgtttatgatagataaaatataggaccctaaattaatagattagattattgcttcacaatgtaacctgttcgtaaatcttgttgatttctttaccaaatatattgttcgtaagtttttgctaattgcttctatttaaagcaataatttttgtttcttatagtatgttctcacgttttgtttttgtcttttttctcttttttaaaagtgtttaaagcaatttctttgtgttgaaaacagcgaaacaatccagaagttttcagagaagttagcagaattggatgtaatggtgagaagaatggttatggagagctttgggatagagaagtactttgatgaacacctcaagtcaacaaattaccgtctgcgactgatgaagtatatagcaccacctgaagttgatactaatgttgcggtgggtgctaatgatgctggtgatggtgctaatgatgcaagtgctagtgataaggccaatgttgttgctggggatgaagataatgttggtgctgatactagtgatattgctaatggtatagctaatgttcatattgatgatgacgctaaggctaatggcgacattggtgctgatgttgatgctaaaactagtgattgtgctaatgttgagtctaaagccgatgttagtaccgatgttaatgccaattctgattccaatgctaatactggtactcttagtagtgctagtgttggtgatattgttaaagctaatggtggtgctgatgatgaggagaagaaattaggtttaccttctcatactgataaaaatcttttcacggtgctttatcaatatgagattgaaggtttggaggtgttaaccaaagatgaaaagtggataagattgaaaccatctcataactctttcgttgttatggctggagattccgcatatgtaagttaacttcttctcctttttttaagacgacatgcagacgtaaaatattaacattcaccattgcattcatgattctatgtcccataatttacttttatattatttttaatgaaaaataagaatttttacttttatattataaaaaaaatcaaactaaattgtttttactgtttcattgtattatttgaaactattaaaattcagagcctatatatatatatatatatatatatataacttttgatgtaattttctttctacacgttgatgatttgagatctctccaaaagttttaatgtttgatatggttatgcatgattacatagtctatctactagaactaaattgagacagagaaagtgttggaataatagaaagtaatccatcttttaaaattagaagtcgaggaagaaaaaacttttttaaaaaactagtggagaaaagaaaaagatgatttcaattcacttttactaaggtgaccaaccaaatttgctctcgacaaactaatttcttatgattctaattcctcttgttcactctcactagtcactagggttagggaccaaccaaatcttatagcaactaatgtttttttttgctcttatcgctttcgctagcaagcgtatatgtcttggcaatacaccatgtgtttcttttctcctgatcatgacctttctcttaacaaaggataaagtaacaattttaccaaaaaaaaggataaagtaacgatgatgtacctggtgattttttgtcattttgtttgcaggcacttatgaatggtagactttttcgtccgtttcatcgagtaagagtaacggagaaaaagaagacaagatattcaatagcattattctcaactccaaacgcaggtaacatcatagaaccaccaaaagaacttgtggacgagaagcatccacgagtcttcaaaccattcacttatgttgacttgatgagtttctatcacactgaggctggtcgtagagctcgatctactcttcatgcttattgtgccgtctccgaagcatga

SEQ ID NO: 733 - DNA, 4049 bp, Brassica juncea
atgggttcagacagtactcctcaacttccagtgatctatctctcggaccaaaccctaaaaccaggaagtgagaagtgggttgaagtgaggagtgatgtccgtaaagctcttgaagactacggcgctttcgaggtgtcatatgatagagtgtcagaggagcttaaggaatcggttttggaagccatgaaagagcttttcgacttaccagttgaggctaagcagagaaacgtgtctccaaaaccctacactggatattctactcataatggtctctccgagagtctagggatccaggatgctgaggttttggagaaagttaacgagtttactcaactgctacgtcctgattgtgagggtaacaagagtatcaggtaaggttatgttatgtgaaaagaacaatattgcttatgatgtgcaggaaatcgttaagcggtaattaagcgatgtaaatggaactagttcctaggcgtcatatagaccaatatttttaacaatcgatatagaaaatcattcgtagtctatggctgattttccgtatagactacctagaccgagttttacaacacaactagattttgacccgcaaatccttgtggatattttcattttataaatgtataattttgatatatcctaagttttctagttttttttgtcatcaaaatgttgtaaatatatgatttatattttaatattatatattttgtaactctataatcttattggttaagttttttattcgacattattcatatataatgatttgctttatacattttacatttgttatataattttattatttttcaatcgttcataaataaattcataatttgaaataatcaaatagagaatctccttcaattttatatattgcatgcataatatcattttaaaattttatttagttatactatagaaatgatatattgtttaggataatttatattatcatattgtgtttaaaaaatatactttaacatatattattttagtatttactgcagatttataagtaaatacattgtttaatttaaagtaattaacacgtattattttaataaattttatacatagagccatctatcatacttatcttgtaattttattcgtatatgatatattttggatgtttatgatattaattttttgattaattaaattaagacttcaaaatattagattactttaatttttataacatagtttgttttttcgtgttacatttcaaaaagttattctttattatctatgattataccttcagaaaaatttaaaacattatcattttaagtttgcatacttattttttaaattttatattttgtcaaattgtttggaaaattacacaactatatttgaggtgggagattatatgatttttgaaatttgtttgttgctaaattaatacattatttttatataaataatattaatttggtaagattattttcttaaatattttttataatttaatgtaaaattaaaatttctatttaaatttgatttttcgttaaattttagaatgaattattaaaatttcatagttttctaataacatatttttaaatagttatgactaaagttattatttattatattgataaacattataaaaatatattgttgggagtttcaaaataaataaaaggatatatatgttgagatataaaattttaacactatgttaataaatttatttttgtataaaatattattagttagatgttaaccattttaatgataatgataatttattaaatgaaataatttaataaaaacttaattactatgaatataattgtcatatttaattcactatctcaattcatttttatataatacataatataatatagaatactataaaataatcgtataaatttatattttcttttgttttatgaataaaattttattaacattagatttgtaactaatattttattactaattacgaaattaattaatatgttattttataaaaatatttaaatttagtaagattttgttacattctttttcaagatattttaaaattcaattttatagttggtttattattaatgtaaataatcaaatatgtcacattacctaatttataaatggtcctactatgatttgtttatgatagataaaatataggaccctaaattaatagattagattattgcttcacaatgtaacctgttcgtaaatcttgttgatttctttaccaaatatattgttcgtaagtttttgctaattgcttctatttaaagcaataatttttgtttcttatagtatgttctcacgttttgtttttgtcttttttctcttttttaaaagtgtttaaagcaatttctttgtgttgaaaacagcgaaacaatccagaagttttcagagaagttagcagaattggatgtaatggtgagaagaatggttatggagagctttgggatagagaagtactttgatgaacacctcaagtcaacaaattaccgtctgcgactgatgaagtatatagcaccacctgaagttgatactaatgttgcggtgggtgctaatgatgctggtgatggtgctaatgatgcaagtgctagtgataaggccaatgttgttgctggggatgaagataatgttggtgctgatactagtgatattgctaatggtatagctaatgttcatattgatgatgacgctaaggctaatggcgacattggtgctgatgttgatgctaaaactagtgattgtgctaatgttgagtctaaagccgatgttagtaccgatgttaatgccaattctgattccaatgctaatactggtactcttagtagtgctagtgttggtgatattgttaaagctaatggtggtgctgatgatgaggagaagaaattaggtttaccttctcatactgataaaaatcttttcacggtgctttatcaatatgagattgaaggtttggaggtgttaaccaaagatgaaaagtggataagattgaaaccatctcataactctttcgttgttatggctggagattccgcatatgtaagttaacttcttctcctttttttaagacgacatgcagacgtaaaatattaacattcaccattgcattcatgattctatgtcccataatttacttttatattatttttaatgaaaaataagaatttttacttttatattataaaaaaaatcaaactaaattgtttttactgtttcattgtattatttgaaactattaaaattcagagcctatatatatatatatatataacatttgatgtaattttctttctacacgttgatgatttgagatctctccaaaagttttaatgtttgatatggttatgcatgattacatagtctatctactagaactaaattgagacagagaaagtgttggaataatagaaagtaatccatcttttaaaattagaagtcgaggaagaaaaaacttttttaaaaaactagtggagaaaagaaaaagatgatttcaattcacttttactaaggtgaccaaccaaatttgctctcgacaaactaatttcttatgattctaattcctcttgttcactctcactagtcactagggttagggaccaaccaaatcttatagcaactaatgtttttttttgctcttatcgctttcgctagcaagcgtatatgtcttggcaatacaccatgtgtttcttttctcctgatcatgacctttctcttaacaaaggataaagtaacaattttaccaaaaaaaaggataaagtaacgatgatgtacctggtgattttttgtcattttgtttgcaggcacttatgaatggtagactttttcgtccgtttcatcgagtaagagtaacggagaaaaagaagacaagatattcaatagcattattctcaactccaaacgcaggtaacatcatagaaccaccaaaagaacttgtggacgagaagcatccacgagtcttcaaaccattcacttatgttgacttgatgagtttctatcacactgaggctggtcgtagagctcgatctactcttcatgcttattgtgccgtctccgaagcatga

SEQ ID NO: 734 - DNA, 1808 bp, Brassica juncea
atgggtgcagacactcctcaacttccagtcatctatctctcggaccaaaccctgaaaccaggaagtgagaagtgggctgaagtcaggagtggtgtccgtaaagctctcgaagaatatggtgctttcgaggtgtcatatgatagagtgacagaggagcttaagaagtcagttttggatgccatgatagagcttttcgagttaccagttgaggctaaacagagaaacgtgtctccgaaaccctacatgggatattcgactcataatggtctctctgagagtctagggatccaggatcccaatgttttggagaaagttaacgaatttactcaactgctacgccctgattgtgagggtaacaagagtatgaggtaactgtcatgtcaagaaaaactcaataatgctccgtataataaattgttcgtaaactattgttaattttagtcaaatgtattttygtaatttttttagttgcttttataagttatgcgacaattttctatatgaaaccttgttttatttatttttttgtgtggaaaacatgtcaggttcactcatatagcaatgaactgatattttgtttcaatcacacgtttctcgcattttattttcttgtttctataaaatagctatactaattttctttctattgaaaacagcgaaacaatccagaagttttcagagaagttagtagaattggatgtaactgtgaaaagaatggtcatacagagctttgggatagagaactactttgatgaacacctcaagtcattgaagaattaccgtatgcgactgatgaagtacgtagcaccacctgatgttgatgctaaagatgctgatgatggtgccaatacgaatctgaatgctaacgctgatgcggatgctggtgctggtgatattgctaatggtattgctaatgttcatattgatgaagatgttaatgccaagggtgacgttkgcactggtggtggtgatgctaatcataatggtgatgatgctaatactggtgattctgctagtgtaaagtcgaatgttgacgttggtactgatgttaatgttaaagctagtgttggtgctgatgttaacgttggcactattgctgatgctaatgctaatattggtactcttagtagtgctaatgttggcgttggggatagtgttaaagctaatggtggcgctgatgatgaggagaagaaattaggtttaccttctcatactgataaaaacctcttgacggtactttatcaatatgagattgatggtttggaggtgttgaccaaagatgaaaagtggatcaggttgaaaccagctcacaactctttcgttgttatagctggagattctctatatgtaagttttaacttattttttatttttaaatgacatgcaccgtaatatattaattgcgatcctataataatcaagactttttatttgctcttataactaattcacaagtgcatgtttttactaaagcgttatatacatcattttatgttttcttctgatcataaatcttgtgttgatgtttttattatttttgtgtgcaggcacttatgaatggtagactatctcgcccgtttcatagagtaagggtaacagaaagaaagaagacaaggtattcaatagcattgttctcggctccagacggagattacatcatcgaaccaccaaaagagcttgtggacgagaagcacccacgtctcttcaaaccattcacatatgctgacttgatgagtttctatcacactgaagctggtcgtagatctcgttctactcttgacgcttattctgctgtctctggagcataa

SEQ ID NO: 735 - DNA, 1808 bp, Brassica juncea
atgggtgcagacactcctcaacttccagtcatctatctctcggaccaaaccctaaaaccaggaagtgagaagtgggctgaagtcaggagtggtgtccgtaaagctctcgaagaatatggtgctttcgaggtgtcatatgatagagtgacagaggagcttaagaagtcagttttggatgccatgatagagcttttcgagttaccagttgaggctaaacagagaaacgtgtctccgaaaccctacatgggatattcgactcataatggtctctctgagagtctagggatccaggatcccaatgttttggagaaagttaacgaatttactcaactgctacgccctgattgtgagggtaacaagagtatgaggtaactgtcatgtcaagaaaaactcaataatgctccgtataataaattgttcgtaaactattgttaattttagtcaaatgtatttttgtaatttttttagttgcttttataagttatgcgacaattttctatatgaaaccttgttttatttatttttttttgtggaaaacatgtcaggttcactcatatagcaatgaactgatattttgtttcaatcacacgtttctcgcattttattttcttgtttctataaaatagctatactaattttctttctattgaaaacagcgaaacaatccagaagttttcagagaagttagtagaattggatgtaactgtgaaaagaatggtcatacagagctttgggatagagaactactttgatgaacacctcaagtcattgaagaattaccgtatgcgactgatgaagtacgtagcaccacctgatgttgatgctaaagatgctgatgatggtgccaatacgaatctgaatgctaacgctgatgcggatgctggtgctggtgatattgctaatggtattgctaatgttcatattgatgaagatgttaatgccaagggtgacgttggcactggtggtggtgatgctaatcataatggtgatgatgctaatactggtgattctgctagtgtaaagtcgaatgttgacgttggtactgatgttaatgttaaagctagtgttggtgctgatgttaacgttggcactattgctgatgctaatgctaatattggtactcttagtagtgctaatgttggcgttggggatagtgttaaagctaatggtggcgctgatgatgaggagaagaaattaggtttaccttctcatactgataaaaacctcttgacggtactttatcaatatgagattgatggtttggaggtgttgaccaaagatgaaaagtggatcaggttgaaaccagctcacaactctttcgttgttatagctggagattctctatatgtaagttttaacttattttttattttgaaatgacatgcaccgtaatatattaattgcgatcctataataatcaagactttttatttgctcttataactaattcacaagtgcatgtttttactaaagcgttatatacatcattttatgttttcttctgatcataaatcttgtgttgatgtttttattatttttgtgtgcaggcacttatgaatggtagactatctcgcccgtttcatagagtaagggtaacagaaagaaagaagacaaggtattcaatagcattgttctcggctccagacggagattacatcatcgaaccaccaaaagagcttgtggacgagaagcacccacgtctcttcaaaccattcacatatgctgacttgatgagtttctatcacactgaagctggtcgtagatctcgttctactcttgacgcttattctgctgtctctggagcataa

SEQ ID NO: 736 - DNA, 1805 bp, Brassica juncea
atgggtgcagacactcctcaacttccagtcatctatctctcggaccaaaccctgaaaccaggaagtgagaagtgggctgaagtcaggagtggtgtccgtaaagctctcgaagaatatggtgctttcgaggtgtcatatgatagagtgacagaggagcttaagaagtcagttttggatgccatgatagagcttttcgagttaccagttgaggctaaacagagaaacgtgtctccgaaaccctacatgggatattcgactcataatggtctctctgagagtctagggatccaggatcccaatgttttggagaaagttaacgaatttactcaactgctacgccctgattgtgagggtaacaagagtatgaggtaactgtcatgtcaagaaaaactcaataatgctccgtataataaattgttcgtaaactattaattttagtcaaatgtattttcgtaatttttttagttgcttttataagttatgcgacaattttctatatgaaaccttgttttatttatttttttgtgtggaaaacatgtcaggttcactcatatagcaatgaactgatattttgtttcaatcacacgtttctcgcattttattttcttgtttctataaaatagctatactaattttctttctattgaaaacagcgaaacaatccagaagttttcagagaagttagtagaattggatgtaactgtgaaaagaatggtcatacagagctttgggatagagaactactttgatgaacacctcaagtcattgaagaattaccgtatgcgactgatgaagtacgtagcaccacctgatgttgatgctaaagatgctgatgatggtgccaatacgaatctgaatgctaacgctgatgcggatgctggtgctggtgatattgctaatggtattgctaatgttcatattgatgaagatgttaatgccaagggtgacgtttgcactggtggtggtgatgctaatcataatggtgatgatgctaatactggtgattctgctagtgtaaagtcgaatgttgacgttggtactgatgttaatgttaaagctagtgttggtgctgatgttaacgttggcactattgctgatgctaatgctaatattggtactcttagtagtgctaatgttggcgttggggatagtgttaaagctaatggtggcgctgatgatgaggagaagaaattaggtttaccttctcatactgataaaaacctcttgacggtactttatcaatatgagattgatggtttggaggtgttgaccaaagatgaaaagtggatcaggttgaaaccagctcacaactctttcgttgttatagctggagattctctatatgtaagttttaacttattttttatttttaaatgacatgcaccgtaatatattaattgcgatcctataataatcaagactttttatttgctcttataactaattcacaagtgcatgtttttactaaagcgttatatacatcattttatgttttcttctgatcataaatcttgtgttgatgtttttattatttttgtgtgcaggcacttatgaatggtagactatctcgcccgtttcatagagtaagggtaacagaaagaaagaagacaaggtattcaatagcattgttctcggctccagacggagattacatcatcgaaccaccaaaagagcttgtggacgagaagcacccacgtctcttcaaaccattcacatatgctgacttgatgagtttctatcacactgaagctggtcgtagatctcgttctactcttgacgcttattctgctgtctctggagcataa

SEQ ID NO: 737 - DNA, 2115 bp, Brassica juncea
atggcatcaatcagtttgcttggccgaatactatcaagacccacaaaaaccaaagaccggtctcgtcagcttcctcctggaccaccaggatggcccatcctcggcaatttgcccgaactaatgatgactcgtcctaggcacaaatatatcgacatcgccttgaaagggcaaaaaccggagatcgcatgtttcaacttcgccggaacacacgccatcgtcataaactctgacgagatcgctcgagaagcgcttaaagagcgagacgccgacttcgcagaccggccaaatcttttcaacatgagaaccatcggaggcaatcacaaatcaatggggaactcaccctacggtgaacagttcatgaagatgaaaagagtgatcactacggagattatgtccgttaaaacattaaacatgttagtagctgcgagaactgttgaagcggacaacctccttgcttaccttctctccatgtacaaacggtctgagactgctgacgttagagagttctcgagggtttatggttacgctgtgaccatgagattgttgtttggaaggagacatatcacgaaagaaaatgttttctccgacgagggaaggttaggacaagcggagaaagatcatcttgatgcgattttcgaaaccttaaactgtttgccgagtttctctccggcggattacttggaaaaatggtttagaggttggaacattgatggtcaagaggagagggtggtaatgtactgtaataaagttcgcagttacaacaatccgatcattgacgagagggtggagctatggagggaaaaaggtgggaaagcagctgttgaagattggattgatactttcattacgctaaaagatgaaaatggaaagtattatatcacgccggatgaggtcaaagctcaatgcgttgtaagtaaacactatactattttactactataattgattatataacattagacaattacaagatattaatacaaaatactatgatcatcgaagtaatacattacagtatatatatacactactgatactattgaaaatggcattagggatagttttacatgatttttgtttcaaaagaaatatatctactaaaaataatattaatttttttttattgtatggagaatcaacttttattaattgttttaggatcccactaaaatctattgtttgatgttttgtttctgcaggagttttgtatagcagcgatcgataatccggcaaataacatggaatggacacttgcggaaatgttaaaaaacccggagattctcaaaaaagctttgaaggagttagacgaagtggtgggaagagacaggcttgttcaggaatctgacataccaaatctaaactacttaaaagcttgttgcagagaaacattcaggattcaccctagtgctcattatgtccctacacatgtggctcgtcaagataccaccctcgggggttatttcattcccaaaggtaaaaagttgtatattatcttaggaattacgtttttacaatagttaaggttatgcgtggttagattataaaatattccaccaaccgtatatataaggaatattgttgatatttttacaggtaaatccatgacatttttttttttaattatgatgcatctgaatattccacacatacacataagaaaaagataaaatcaaacatgtaaccagttgagccaccaataatttgatatgatacatatattaagaaagtatatattggttttggacaggtagccacattcatgtagggcgtccaggaataggccggagctccaaagtatggaaagatccattggtatacaaaccagagcgtcacctcgaaggagatggaatctcgaaggagctttctctggtcgaaagtgaattgcgtttcgtgtcgtttggtaccggtcggcgtggctgcgtcggtgtcaaagtcgggacgatcatgatggttataatgttggctaggtttcttcaagcgtttaactggaaactccatcctggttacggaccgttaagtctagaggaagatgatgcattgcttatggctaaacctcttctcttgtccgttgagccacgcttggcacccaacctttatccaaaattctgcccttga

SEQ ID NO: 738 - DNA, 2115 bp, Brassica juncea
atggcatcaatcagtttgcttggccgaatactatcaagacccacaaaaaccaaagaccggtctcgtcagcttcctcctggaccaccaggatggcccatcctcggcaatttgcccgaactaatgatgactcgtcctaggcacaaatatatcgacatcgccttgaaagggcaaaaaccggagatcgcatgtttcaacttcgccggaacacacgccatcgtcataaactctgacgagatcgctcgagaagcgcttaaagagcgagacgccgacttcgcagaccggccaaatcttttcaacatgagaaccatcggaggcaatcacaaatcaatggggaactcaccctacggtgaacagttcatgaagatgaaaagagtgatcactacggagattatgtccgttaaaacattaaacatgttagtagctgcgagaactgttgaagcggacaacctccttgcttaccttctctccatgtacaaacggtctgagactgctgacgttagagagttctcgagggtttatggttacgctgtgaccatgagattgttgtttggaaggagacatatcacgaaagaaaatgttttctccgacgagggaaggttaggacaagcggagaaagatcatcttgatgcgattttcgaaaccttaaactgtttgccgagtttctctccggcggattacttggaaaaatggtttagaggttggaacattgatggtcaagaggagagggtggtaatgtactgtaataaagttcgcagttacaacaatccgatcattgacgagagggtggagctatggagggaaaaaggtgggaaagcagctgttgaagattggattgatactttcattacgctaaaagatgaaaatggaaagtattatatcacgccggatgaggtcaaagctmaatgcgttgtaagtaaacactatactattttactactataattgattatataacattagacaattacaagatattaatacaaaatactatgatcatcgaagtaatacattacagtatatatatacactactgatactattgaaaatggcattagggatagttttacatgatttttgtttcaaaagaaatatatctactaaaaataatattaatttttttttattgtatggagaatcaacttttattaattgttttaggatcccactaaaatctattgtttgatgttttgtttctgcaggagttttgtatagcagcgatcgataatccggcaaataacatggaatggacacttgcggaaatgttaaaaaacccggagattctcaaaaaagctttgaaggagttagacgaagtggtgggaagagacaggcttgttcaggaatctgacataccaaatctaaactacttaaaagcttgttgcagagaaacattcaggattcaccctagtgctcattatgtccctacacatgtggctcgtcaagataccaccctcgggggttatttcattcccaaaggtaaaaagttgtatattatcttaggaattacgtttttacaatagttaaggttatgcgtggttagattataaaatattccaccaaccgtatatataaggaatattgttgatatttttacaggtaaatccatgacatttttttttttaattatgatgcatctgaatattccacacatacacataagaaaaagataaaatcaaacatgtaaccagttgagccaccaataatttgatatgatacatatattaagaaagtatatattggttttggacaggtagccacattcatgtagggcgtccaggaataggccggagctccaaagtatggaaagatccattggtatacaaaccagagcgtcacctcgaaggagatggaatctcgaaggagctttctctggtcgaaagtgaattgcgtttcgtgtcgtttggtaccggtcggcgtggctgcgtcggtgtcaaagtcgggacgatcatgatggttataatgttggctaggtttcttcaagcgtttaactggaaactccatcctggttacggaccgttaagtctagaggaagatgatgcattgcttatggctaaacctcttctcttgtccgttgagccacgcttggcacccaacctttatccaaaattctgcccttga

SEQ ID NO: 739 - DNA, 2115 bp, Brassica juncea; identical to SEQ ID NO: 737

SEQ ID NO: 740 - DNA, 2163 bp, Brassica juncea
atgacaatgatgatgatgagccttaccacatcgttaccgtacccttttcaaatcctactagtctttatcttgtccatagcatccatcactttgcttggccgaatactatcaagacccacaaaaaccaaagaccggtctcgtcagcttcctcctggaccaccaggatggcccatcctcggcaatttacccgaactaatgaagactcgtcctaggcacaaatatttcgaaattgccacgaaagggcaaaaaccggagatcgcgtgtttcaacttcgccggaacacacaccatcatcataaactcggatgagatcgctcgagaagcgtttaaagagcgagacgccgacttcgcagaccggccaaatactttcaacatgagaaccatcggaggcaatcacaaatcaatggggaacacacccaccggtgaacagttcatgaaaatgaaaagagtgatcacatcggagattatgtccgtgaaaacattaaacatgttggtagcttccagaaacattgaagcggacaacctccttgcttaccttctctcgatttataaacggtccgagacagccgacgttagagagatctcgaggaattatggttacgctgtgacaatgagaatgatgtttggaaggagacatgtcacgaaagaaaatgttttctccgacgagggaaggttaggaccagcggagaaagatcatcttgatgcgatcttcgaaacgttaaactgtttgccgagtttctctccggctgattacttggaaaaatggtttctcggctggaacgttgatggtctagaggagagggtgacagtgaactgtaataaagtccgcagttacaacaatccgatcattgacgagagggtggagttatggagagaaaaaggtggtaaggcagctgttgaagattggattgatacgttcattaccctaaaagatgaaaacggaaagtattatatcacgccggatgaagtcaaaggtcaatgcgttgtaagtgaacactagtagtattttactactataattgattatatatcataagacagttacaagatattattacaaaatattatgatcatcgacagtatagatatactactgatattattgaaaatggcattgcggatagttttacatgttttttgtttcaaaagaaatatatcaacaaaaaattaatatttagattttttttgttatatgaagaatcaacttttattaattgttttaggaccccgttaaatatattgtttggtgttttatttcaggaattttgcatagcagcgatcgataatccggcaaataacatggaatggacacttgcggaaatgttaaagaacccggagattctcaaaaaagctttgaaggagttagacgaagtggtgggaagagacaggcttgttcaggaatctgacataccaaacctaaactacttaaaagcttgttgcagagaaacattcagggttcacccaagtgctcattatgtccctactcatgtggctcgtcgagatagcaccctcggaggttatttcattcccaaaggtaaaacaacaaaaattgtgtagtaactcaagactttacatttttacaatagcaaagcttatgcatagttagattgtaacaatatttgcgacgattaaaattctaccaaacgtattcaaaatttggatcatgcatctaaccatatacaaagtaatcttgttgattttgtttagattcatgactggtttttgatgatgcgtgcaaatactccaccagtagttttgtatgatgcgtgtattaaaaaagtatttgttttggacaggtagccacattcacgtcgcccgtcctggaataggccggagctccaaagtatggaaagatccattggtatacaaaccggagcgtcacctcgaaggaaatggaatctcgaaggagctttctctggtcgaaaatgaaatgcgtttggtgtcgtttggtaccggtcggcgtggctgcatcggtgtgaaagtcgggacgatcatgatggttataatgttggctaggtttcttcaagcgtttaactggaaactccatcctagttatggaccgttaagtctagaggaagatgatgcattgcttatggctaagcctcttctcttgtccgttgagccacgcttggcacccaacctttacccaaaattctacccttga

SEQ ID NO: 741 - DNA, 2163 bp, Brassica juncea; identical to SEQ ID NO: 113

SEQ ID NO: 742 - DNA, 2163 bp, Brassica juncea; identical to SEQ ID NO: 740

SEQ ID NO: 743 - protein, 551 aa, Raphanus raphanistrum
MKHLWLALTFLLALAICKADEEISCEENVPFTCGQTHRFNSSSFEKDFIFGLASSAYQACNISTISNIEGSINRGLNVWDGFTHRFPHKAGPDNGNGDTTCDSYSYWEKDIEVMDELKATGYRFSIAWSRIIPRGKRSRGVHRGGINYYHGLIDGLIEKGITPLVTLFHWDLPQVLQDDYEGFLDPQIIEDFRDYADLCFEEFGDKVKNWFTINQLYSVPTRGYGLGADAPGRCSPKVDSTCYAGNSSTEPYIVAHNQLLAHAKVVDLYRTKYKHQGGKIGPVMITRWFLPYNDTDPDCIVATERMKEFFLGWFMGPLTNGTYPQIMIDTVGERLPSFTPEESKLVKGSYDFLGLNYYFSQYVQPSPNHVDRDDHTAMMDAGARLTFRNASNHLIGPVFADHRDDETRNIYYYPKGIYYVMDHFKTKYNDPLIYITENGFVTSDETREEAKFDYRRIDYLCSHLCFLSKVIKETGVKVKGYCAWSLGDNYEFGQGFTVRFGLTYIDWNNVTDRDLKESGKWYKKFLATKNPAKKDFLRSSLTFEKKKLADA

SEQ ID NO: 744 - protein, 366 aa, Raphanus raphanistrum
MKHLGLILAFLLAVATCKADEEITCQENLPFKCSQTGRLNSSSFEKDFIFGVASSAYQAYKSGPDHGNGDTTCDSFSYWQKDIDVLDELNATGYRFSIAWSRIIPRGKRSRGVNKEGINYYHGLIDGLIDKGITPFVTLFHWDLPQVLQDEYEGFLDRRIIDDFKEYADLCFREFGHKVKNWITINQLYTVPTRGYALGSDAPGRCSPAVDPTCYAGNSSSEPYIVAHNQLLAHATVVDLYRKNYSQQGGKIGPVMITRWFLPYNDTDPGSIAATERMKEFFFGWFMGPLTNGTYPQIMIDTVGVLLPSFSPEESNLVKGSYDFLGLNYYVTQYAQPSPNHVHWANHTALMDAGATLTCTTQYISA

SEQ ID NO: 745 - protein, 526 aa, Raphanus raphanistrum
MKHVGLILAFLLAVATCKADEEISCEENLPFTCGHTDRLNSSNFEKDFIFGVASSAYQAYKGGPDHGNGDTTCDSYSYWKNDIKVMNELKATGYRFSIAWSRIIPGGKRSRGVNQEGINYYHGLINGLVDKGITPFVTLFHWDLPQALQDDYEGFLDSQIIDDFKDYADLCFQEFGHKVNNWITINQLYTVPTRGYALGTDAPGRCSPMVDPTCYAGNSSTEPYIVAHNQLLAHATVVDLYRKNYSHQGGKIGPVMITRWFLPYNDTDPDSIAATERMKEFFLGWYMGPLTNGTYPQSMIDTVGERLPSFTPEESNLVKGSYDFLGLNYYVTQYAQPSPNHVDWDNHTALMDAGAMLTYRNASNHVIGPLFAVDKHDETKNSYYYPKGIYYVMDYFKTKYYNPLIYVTENGISTPGDETLVVAMSDSTRIDYICSHLCFLSKVIKETGVNVKGYFAWSLGDNYEFCQGFTVRFGLSYVDWKNVTDRNLKDSGKWYKKFIATKNPGKQDFLFSSLTFEKKKKKLADA

SEQ ID NO: 746 - protein, 542 aa, Raphanus raphanistrum
MKHIGLILVFLLAVATCKADEETTCKESVSECGHTDKFNSGSFEKDFIFGVASSAYQACSVGRGLNIWDSFTHRYPSKSGSDHGNGDTTCDSYSYWEKDIEALVELKATGYRFSIAWSRILPKGKKSRGVNKEGIKYYQGLIKELINRGITPFVTLFHWDLPQTLQDEYGGFLSRRIIQDFRDYADVCFKEFGADVKNWITINQLYTVPTRGYGFGSDAPGRCSIALDPTCETGNSSSEPYMVAHHQLLAHATVVHHYRKHYSDQGGKIGPVMITRWFLPYNPSDQDSIDATEKMKQFFLGWFMGPLTNGAYPKIMIDTVGQRLPSFTPDESKLVKDSYDFLGLNYYVTQYVQSSPNHVDWDNHTAMMDAGTTLTYVDVNGDPIGPLFTEDKVDKNKSTYYYPEGIYDVMKFFKTNYSDPLIYVTENGFSTPGDQTRKEAKLDCKRIDYLCSHLYYLSKVIKDTGVNVKGYFAWSLGDNYEFCKGFTVRFGLSYVDWNNVNDRDLKQSGKWYKKFITTKDPPKKDFLRSSLTFEKKKKFADA

SEQ ID NO: 747 - protein, 503 aa, Raphanus raphanistrum
MQRCMVVSFHFRSKEGEVVVLTFGMVSVTDTQLLSEKSGSDLKNGDTTCESYTRWQKDVDVMGEINATGYRFSFAWSRIIPKGKVSRGVNQGGLEYYHKLIDALLEKNITPFVTLFHWDLPQTLQDEYEGFLDRQIIQDFKDYADLCFKEFGGKVKHWITINQLYTVPTRGYAIGTDAPGRCSPMVDTKHRCYGGNSSTEPYIVAHNQLLAHAAAVDLYRTKYKFQKGKIGPVMITRWFLPYDDSDPASIEAAERMNQFFHGWYMEPLTKGRYPDIMRQIVGSRLPNFTEEEAALVAGSYDFLGLNYYVAQYTQPKPNPYPSETHTAMMDAGVKLTYENSRGELIGPLFVEDKDNGNSYYYPKGIYYVMDYFKTKYGDPLIYVTENGFSTPGSEKREQAIADYKRIDYLCSHLCFLRKVIKEKGVNVRGYFAWALGDNYEFCKGFTVRFGLSYVNWDDLDDRNLKESGQWYQRFINGTVKNPAKQDFLRSSLSSQSQKRLADA

SEQ ID NO: 748 - protein, 559 aa, Raphanus raphanistrum
MKIHSLRPISQPKLFSSVDSDGFLPDKALELNDEAGYRVMVPEEARELERQLGQVSKEKNEAVRGQDFEKIEGGRGRGVNVWDGFTHRYPEKAGSDLKNGDTTCESYTRWQKDVDVMGELNATGYRFSFAWSRIIPKGKVSRGVNQGGLEYYHKLIDALLEKNITPFVTLYHWDLPQTLQDEYEGFLDRQIIQDFKDYADLCFKEFGGKVKHWITINQLYTVPTRGYAIGTDAPGRCSPMVDSKHRCYGGNSSTEPYIVAHNQLLAHATIVDLYRTKYKFQKGKIGPVMITRWFLPYDESDPASIEAAERMNQFFHGWYMEPLTKGRYPDIMRQIVGSRLPNFTEEEAELVAGSYDFLGLNYYVTQYAQPKPNPYPSVTHTAMMDAGVKLTYDNSRGEFVGPLFVEDKDNGNSYYYPKGIYYVMDYFKTKYGDPLIYVTENGFSSPGSENRVQAIADYKRIDYLCSHLCFLRKVIKEKGVNVRGYFAWSLGDNYEFCKGFTVRFGLSYVNWDDIDDRNLKESGKWYQRFINGTAKNHAKQDFLRSSLSSQSQKKRLADA

SEQ ID NO: 749 - protein, 522 aa, Raphanus raphanistrum
MKLLGLALVLLLAAASCKAGEEITCEENEPFTLKALEKTSSSVLHLLLTRHIEGGRGRGVNIWDGFSHRYPEKSGSDLKNGDTTCESYTRWQKDVDVMGEINATGYRFSFAWSRIIPKGKVSRGVNQGGLEYYHKLIDALLEKNITPFVTLFHWDLPQTLQDEYEGFLDRQIIQDFKDYADLCFKEFGGKVKHWITINQLYTVPTRGYAIGTDAPGRCSPMVDTKHRCYGGNSSTEPYIVAHNQLLAHAAAVDLYRTKYKFQKGKIGPVMITRWFLPYDDSDPASIEATERMNQFFHGWYMEPLTKGRYPDIMRQIVGSRLPNFTEEEAALVAGSYDFLGLNYYVAQYTQPKPNPYPSETHTAMMDAGVKLTYNGNSYYYPKGIYYVMDYFKTKYGNPLIYVTENGFSTPSSEKREQAIADYKRIDYLCSHLCFLRKVIKEKGVNVRGYFAWALGDNYEFCKGFTVRFGLSYVNWDDLDDRNLKESGQWYQRFINGTVKNPAKQDFLRSSLSSQSQKRLADA

SEQ ID NO: 750 - protein, 539 aa, Raphanus raphanistrum
MKLLGLALVLLLAAASCKAGEEITCEENEPFTLKALEKTSSSVLHLLLTRHIEGGRGRGVNIWDGFSHRYPEKSGSDLKNGDTTCESYTRWQKDVDVMGEINATGYRFSFAWSRIIPKGKVSRGVNQGGLEYYHKLIDALLEKNITPFVTLFHWDLPQTLQDEYEGFLDRQIIQDFKDYADLCFKEFGGKVKHWITINQLYTVPTRGYAIGTDAPGRCSPMVDTKHRCYGGNSSTEPYIVAHNQLLAHAAAVDLYRTKYKFQKGKIGPVMITRWFLPYDDSDPASIEATERMNQFFHGWYMEPLTKGRYPDIMRQIVGSRLPNFTEEEAALVAGSYDFLGLNYYVAQYTQPKPNPYPSETHTAMMDAGVKLTYENSRGELIGPLFVEDKDNGNSYYYPKGIYYVMDYFKTKYGNPLIYVTENGFSTPSSEKREQAIADYKRIDYLCSHLCFLRKVIKEKGVNRILRFAWALGDNYEFCKGFTVRFGLSYVNWDDLDDRNLKESGQWYQRFINGTVKNPAKQDFLRSSLSSQSQKRLADA

SEQ ID NO: 751 - protein, 539 aa, Raphanus raphanistrum; identical to SEQ ID NO: 750

SEQ ID NO: 752 - protein, 542 aa, Brassica napus
MKHIWLTLAFLLALATCKADEEINCEENLPFTCGQTDRFNSTSFEKDFIFGLASSAYQACSINRGVNVWDGFTHRFPHKAGPDHGNGDTTCNSYSYWEKDIEVMDELKATGYRFSIAWSRVIPRGKRSRGVHQGGINYYHGLINGLIDKGITPLVTLFHWDLPQVLQDDYEGFLDPQIIDDFRDFADLCFEEYGDKVKHWFTINQLYSVPTRGYGLGSDAPGRCSPKVDSTCYAGNSSTEPYIVAHNQLLAHATVVDLYRTKYKHQGGKIGPVMITRWFLPYNDTDPDSIAATERMKEFFLGWYMGPLTNGTYPQIMIDTVGERLPSFTPEESKLVKGSYDFLGLNYYFTQYVQPSPNHVDSDGHTAMMDAGTRLTYRNASNHAIGPVFTEHKDDETKNTYYYPKGIYYVMDHFKTNYNNPVIYITENGFSTSGDETREEAKFDYRRIDYLCSHLCFLSKVIKETGVKVKGYCAWSLGDNYEFGQGFTVRFGLTYIDWNNVTDRDLKESGKWYKKFIATKNLAKPNFLRSSLTFEKKKFADA

SEQ ID NO: 753 - protein, 526 aa, Brassica napus
MKHLWLTLAFLLALATCKADEEITCEENLPFTCGQTDRFNSSSFEKDFIFGSINRGVNVWDGFTHRFPHKAGPDHGNGDTTCNSYSYWEKDIEVMDELKATGYRFSIAWSRIIPRGKRSRGVHQGGINYYHGLINGLIEKGITPLVTLFHWDLPQVLQDDYEGFLDPQIIDDFRDFADLCFEEYGDKVKHWFTINQLYSVPTRGYGLGSDAPGRCSPKVDSTCYAGNSSTEPYIVAHNQLLAHATVHQGGKIGPVMITRWFLPYNDTDPDSIAATERMKEFFLGWYMYMGPLTNGTYPQIMIDTVGERLPSFTPEESKLVKGSYDFLGLNYYFTQYVQPSPNHVDSDGHTAMMDAGTRLTYRNASNHAIGPVFTEHKDDETKNTYYYPKGIYYVMDHFKTNYNDPVIYITENGFSTSGDETREEAKFDYRRIDYLCSHLCFLSKVIKETGVKVKGYCAWSLGDNYEFGLGFTVRFGLTYIDWNNVTDRDLKESGKWYKKFIATKNLAKPNFLRSSLTFEKKKFADA

SEQ ID NO: 754 - protein, 546 aa, Brassica napus
MKHLGLILAFLLALATCKADEEITCEENLPFKCSQPDRLNSSSFEKDFIFGVASSAYQACCLGRGLNVWDGFTHRYPNKSGPDHGNGDTTCDSFSYWQKDIDVLDELNATGYRFSIAWSRIIPRGKRSRGVNKDGINYYHGLIDGLIDKGITPFVTLFHWDLPQVLQDEYEGFLDPQIIHDFKDYANLCFQEFGHKVKNWLTINQLYTVPTRGYGAGSDAPGRCSPMVDPTCYAGNSSTEPYIVAHNQLLAHATVVDLYRKNYSHQGGKIGPVMITRWFLPYNDTDPDSIAATERMKEFFLGWYMFMGPLTNGTYPQIMIDTVGDRLPSFSPEESNLVKGSYDFLGLNYYVTQYAQPSPNPVHWANHTAMMDAGAKLTYINASNHYIGPLFEANSDETENSYYYPKGIYYVMDYFKTKYYNPLIYVTENGISTPGNETRDESMFDYKRIEYLCSHLCFLSKVIKEKHVNVKGYFAWSLGDNYEFDKGFTVRFGLSYIDWNNVTDRDLKLSGKWYQKFISPAIKNPLKKDFLRSSLTFEKNKKFADA

SEQ ID NO: 755 - protein, 528 aa, Brassica napus
MKHLGLILAFLLALATCKADEEITCEENLPFKCSQPDRLNSSSFEKDFIFGVASSAYQACCLGRGLNVWDGFTHRYPNKSGPDHGNGDTTCDSFSYWQKDIDVLDELNATGYRFSIAWSRIIPRGKRSRGVNKDGINYYHGLIDGLIDKGITPFVTLFHWDLPQVLQDEYEGFLDPQIIHDFKDYANLCFQEFGHKVKNWLTINQLYTVPTRGYGAGSDAPEPYIVAHNQLLAHATVVDLYRKNYSHQGGKIGPVMITRWFLPYNDTDPDSIAATERMKEFFLGWYMFMGPLTNGTYPQIMIDTVGERLPSFSPEESNLVKGSYDYLGLNYYVTQYAQPSPNPVHWANHTAMMDAGAKLTYINASNHSIGPLFEANSDETKNSYYYPKGIYYVMDYFKTKYYNPLIYVTENGISTPGNETRDESMFDYKRIEYLCSHLCFLSKVIKEKHVNVKGYFAWSLGDNYEFDKGFTVRFGLSYIDWNNVTDRDLKLSGKWYQKFISPAIKNPLKKDFLRSSLTFEKNKKFEDA

SEQ ID NO: 756 - protein, 492 aa, Brassica napus
MKHIGLILVFLLAVATCKADEESTCKETLSACGHTDQFNSGSFEKDFIFGVASSAYQACGVGRGLNVWDGFTHRYPNKSGSDHGNGDTTCDSYSYWELNYSMYTYESYNMTKDIEALVELNATGYRFSIAWSRIVPRGKRSRGDLPQALQDEYEGFLDPQIINDFKDYADLCFYEFGDNVTNWITINQLYTVPTRGYGFGSDAPGRCSRALDPTCYAGNSSTEPYIVAHHQLLAHAMVVDLYRKNYTHQGGSCMGPLTNGTYPQIMIDTVRNRLPSFTPEESKLVKGSYDFIGLNYYVTQYVQPSPNHLDWANHTAMMDAGATLTYRNISGHPIGPLFTEDKGDDTKNTYYYPEGISYVMEYFKTKYYNPLIYVTENGFSTPGDQTREDAKLDCKRIDYLSSHLSFLSKVIKEKHVNVKGYFAWSLGDNYEFCKGFTVRFGLSYIDWNNVTDRDLKQSGKWYKKFITTKDLPKKDFLRSSLTFEKKKKFADA

SEQ ID NO: 757 - protein, 531 aa, Brassica napus
MKFRGLDLIVFLLAVVSCKANKEITCEENEPFTCNNTDRLNSKGFPKDFIFGVSSAAYQACGRGRGLNIWDGFTHRYPEKGGSDLGNGDTTCESYTMWQKDIDIMDEMNATGYRFSFAWSRIIPKGKVSRGVNKGGLEYYHRLIDGLIAKNITPFVTLYHWDLPQTLQDEYDGFLNRQVIEDFRDFADLCFKEFGGKVKNWLTINQLYSVPTRGYSTGADAPGRCSPKVDARCYGGNSSTEPYIVAHNQLLAHAAVVNLYRTKYRASTCPFFQRGRIGPVMITRWFLPFDETNKASIDAAERMKEFFLGWYMEPLTRGRYPDIMRRMVGNRLPNFTEAEARLVAGSYDFLGLNYYATQYVQPTPNPLPVTSERYTAMMDPGTRLTFVNSRGEKTGPLFEELKGGNSYYYPKGIYYVMDYFKTKYRNPLIYITENGFSTSGDQTRQEAVADSKRIDYLCSHLCFLRKVIMEKRVNIKGYFAWALGDNYEFGKGFTVRFGLSYVNWTDVSDRNLKDSGKWYQRFINMKTLADA

SEQ ID NO: 758 - protein, 381 aa, Brassica napus
MKLRGLVLIVFLLAVVSCKANGEITCEENEPFTCNNTARLNSKGFPKDFIFGIEGGRGRGLNVWDGFTHRYPEKGGPDLGNGDTTCESYTMWQKDIDILDEMNATGYRFSFAWSRIIPAEGKVSRGVNKGGLKYYHKLIDGLIAKNITPFVTLYHWDIPQTLQDEYQGFLNRQVIDDFRDYADLCFKEFGGKVKNWLTLNQLYTVPTRGYSTGADAPEPYIVAHNQLLAHAAVVNLYRTKYRASTWIIGPVMITRWFLPFNETDRASIDATERMKEFFFGWYMEPLTRGRYPDIMRRMVGSRLPNFTEAEARLVAGSYDFLGLNYYVGQYVQPAPNPLPVTSERYTAMMDPGTRLTSVNARGEKIGPLVCMHDLPTRIYCF

SEQ ID NO: 759 - protein, 538 aa, Brassica napus
MKLRGLVLIVFLLAVVSCKANGEITCEENEPFTCNNTARLNSKGFPKDFIFGVASSAYQACGRGRGLNVWDGFTHRYPEKGGPDLGNGDTTCESYTKWQKDIDILDEMNATGYRFSFAWSRIIPAEGKVSRGVNKGGLKYYHKLIDGLIAKNITPFVTLYHWDIPQTLQDEYQGFLNRQVIDDFRDYADLCFKEFGGKVKNWLTLNQLYTVPTRGYSTGSDAPGRCSPKVDERCYGGNSSTEPYIVAHNQLLAHAAVFQRGIIGPVMITRWFLPFNETDRASIDATERMKEFFFGWYMEPLTRGRYPDIMRRMVGSRLPNFTEAEARLVAGSYDFLGLNYYVGQYVQPAPNPLPVTSERYTAMMDPGTTLTSVNARGEKIGPLFEDFQGSRIYYYPKGIYYVMDHFRTRYRNPLIYVTENGFTTPASENRPEAVADSKRIDYLCSHLCFLRKVIREKRVNIKGYFAWSLGDNYEFAKGFAVRFGLTYVNWTDVSDRNLKDSGRWYQRFINVTSKNTANEDFLRSSLSFKNKMKTLADA

SEQ ID NO: 760 - protein, 553 aa, Brassica napus
MKLHGLALIGFLIAVVSCKAIEECRENEPFTCGNTDQLSSKSFPKDFIFGVASAAYQACYKSTIFDVEGGRGRGLNVWDGFTHRYPEKGGSDLGNGDTTCESYTRWQKDIDIIDELNATGYRFSFAWSRIIPKGKVSRGVNKGGLEYYHKLIDGLIAKNITPFVTLFHWDLPQTLQDEYEGFLNRTVIDDFRDYADLCFKEFGGKVKNWITINQLYTVPTRGYAIGTDAPGRCSPEVDEKCYGGNSSTEPYIVAHNQLLAHAAAVDVYRTKYKFQKGKIGPVMITRWFLPFDKTDQASRDAANRMKEFFLGWFMEPLTKGRYPDIMREIVGSRLPNFTEAEAELVAGSYDFLGLNYYTTQYAQPKPNPVTWANHTAMMDPGAKLTYNNSRGENLGPLFVKDEKNGNAYYYPKGIYYVMDYFKTKYSNPLIYITENGFSTPGEENRDKAIADSKRIDYLCSHLCFLRKVIREKGVNIKGYFAWALGDNYEFCKGFTVRFGLSYVNWTDLNDRNLKKSGKWYQSFINGTTKNPAKQDFRRPNLSLRNQKKNLADA

SEQ ID NO: 761 - protein, 535 aa, Brassica napus
MKLHGLALIGFLIAVVSCKAIEECRENEPFTCGNTDQLSSKSFPKDFIFGVASAAYQACYKSTIFDVEGGRGRGLNVWDGFTHRYPEKGGSDHGNGDTTCESYTRWQKDIDIIDELNATGYRFSFAWSRIIPKGKVSRGVNKGGIEYYHKLLDGLIAKNITPFVTLYHWDLPQTLQDEYEGFLNRTVIDDFRDYADLCFKEFGGKVKNWITINQLYTVPTRGYAIGTDAPGRCSPAVDERCYGGNSSTEPYIVAHNQLLAHAAAVDVYRRKYKFQKGKIGPVMITRWFLPFDETDASRDAAERMKEFFLGWFMEPLTKGRYPDIMREIVGSRLPNFTEAEAELVAGSYDFLGLNYYTTQYAQAKPNPVTWANHTAMMDPGAKLTYNNSRGENLGPLFVKDEKNGNAYYYPKGIYYVMDYFKTKYSNPLIYITENGFSTPGEENRDKAIADSKRIDYLCSHLCFLRKVIREKGVNIKGYFAWALGDNYEFCKGFTVRFGLSYVNWTDLNDRNLKDSGKCSQMHETLYPTIMIIFIS

SEQ ID NO: 762 - protein, 337 aa, Brassica napus
MVDTKHRCYGGNSSTEPYIVAHNQLLAHATVVDLYRTKYKFQKGKIGPVMITRWFLPFDESDPASIEAAERMNQFFHGLYIYIYIYIYNQKCISIYCIYPLTKGRYPDIMRQIVGSRLPNFTEEEAELVAGSYDFLGLNYYVTQYAQPKPNPYPSETHTAMMDAGVKLTYDNSRGEFLGPLFVEDEVNGNSYYYPKGIYYVMDYFKTKYGDPLIYVTENGFSTPSSENREQAIADYKRIDYLCSHLCFLRKVIKEKGVNVRGYFAWALGDNYEFCKGFTVRFGLSYVNWEDLDDRNLKESGKWYQRFINGTVKNSAKQDFLRSSLSSQSRKKRLADA

SEQ ID NO: 763 - protein, 545 aa, Brassica napus
MKLLGLALVFLLASASCKADEEITCEENNPFTCSNTDILSSKNFGKDFIFGVASSAYQAWRGRGVNVWDGFSHRYPEKSGSDLKNGDTTCESYTRWQKDVDVMGELNATGYRFSFAWSRIIPKGKVSRGVNQGGLDYYHKLIDALLEKNITPFVTLFHWDLPQTLQDEYEGFLDRQIIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAALVAGSYDFLGLNYYVTQYAQPKPNPYPSETHTAMMDAGVKLTYDNSRGEFLGPLFVEDKDNGNSYYYPKGIYYVMDYFKTNYGNPLIYVTENGFSTPSSENREQAIADYKRIDYLCSHLCFLRKVIKEKGVNVRGYFAWALGDNYEFCKGFTVRFGLSYVNWDDLDDRNLKESGKWYQRFINGTVKNLAKQDFLRSSLSSQSQKKRLSDA

SEQ ID NO: 764 - protein, 527 aa, Brassica napus
MKLLHGLALVFLLAAASCKADEEITCEENNPFTCSNTDILSSKNFGKDFIFGIEGGRGRGVNVWDGFSHRYPEKSGSDLKNGDTTCESYTRWQKDVDVMGELNATGYRFSFAWSRIIPKGKVSRGVNQGGLDYYHKLIDALLEKNITPFVTLFHWDLPQTLQDEYEGFLDRQIIQDFKDYADLCFKEFGGKVKHWITINQLYTVPTRGYAVGTDAPEPYIVAHNQLLAHATVADHYRKNYAVSSLDIAKKGKIGPVMITRWFLPYDESDPASIEAAERMNQFFHGWYMEPLTKGRYPDIMRQIVGSRLPNFTEEEAELVAGSYDFLGLNYYVTQYAQPKPNPYPSETHTAMMDAGVKLTYDNSRGEFLGPLFVEDEVNGNSYYYPKGIYYVMDYFKTKYGDPLIYVTENGFSTPSSENREQAIADYKRIDYLCSHLCFLRKVIKEKGVNVRGYFAWALGDNYEFCKGFTVRFGLSYVNWEDLDDRNLKESGKWYQRFINGTVKNSAKQDFLRSSLSSQSQKKRLADA

SEQ ID NO: 765 - protein, 546 aa, Brassica napus
MKLLHGLALVFLLAAASCKADEEITCEENNPFTCSNTDILSSKNFGKDFIFGVASSAYQAWRGRGVNVWDGFSHRYPEKAGSDLKNGDTTCESYTRWQKDVDVMGELNATGYRFSFAWSRIIPKGKVSRGVNQGGLDYYHKLIDALLEKNITPFVTLFHWDLPQTLQDEYEGFLDRQIIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAELVAGSYDFLGLNYYVTQYAQPKPNPYPSETHTAMMDAGVKLTYDNSRGEFLGPLFVEDKVNGNSYYYPKGIYYVMDYFKTKYGDPLIYVTENGFSTPSSENREQAIADYKRIDYLCSHLCFLRKVIKEKGVNVRGYFAWALGDNYEFCKGFTVRFGLSYVNWEDLDDRNLKESGKWYQRFINGTVKNAVKQDFLRSSLSSQSQKKRFADA

SEQ ID NO: 766 - protein, 487 aa, Brassica nigra
MKHLWFALAFLLALAICKADEEITCEENLPFTCGQTDRFNSSSFEKDFIFGLASSAYQACNICYISTIRGKRSRGVHQGGINYYHGLINGLIEKGITPLVTLFHWDLPQVLQDDYEGFLDPQIIDDFRDYADLCFEEFGDKVKHWFTINQLYSVPTRGYGLGSDAPGRCSPKVDPTCYAGNSSTEPYIVAHNQLLAHARVVDLYRTKYKHQGGKIGPVMITRWFLPYNDTDQDSIAATERMKEFFLGWFMGPLTNGTYPQIMIDTVGERLPSFTPEESKLVKGSYDFLGLNYYFSQYVQPSPNRVDWDRHIAMMDAGTKLTYRNASNHLIGPVFAEHREDETRNIYYYPKGIYYVMDYFKTKYNNPLIYITENGILTSGDETREEAKFDYRRIDYLCSHLCFLSKVIKETGVKVKGYCAWSLGDNYEFGQGFTVRFGLTYIDWNNVTDRDLKESGQWFKKFIATKNLAKKDFLRSSLTFEKKKFADA

SEQ ID NO: 767 - protein, 259 aa, Brassica nigra
MAEFFIDGGGLIVEKGIEGGGISELEGMINQDPIMEMETLLVTHFHTGRDDFKDYADLCFQEFGHKVKNWLTINQLYTVPTRGYGLGSDAPGRCSPMVDPTCYAGNSSTEPYIVARNQLLAHATVVDLYRKNYTHQGGKIGAVMITRWFLPYNDTDPDSIAATERMKEFFLGWFMGPLTNGTYPQIMIDAVGDRLPPFSPEESKLVKDSYDFLGLNYYVTQYVQPSPNQVDWANYTAMMDANATLTCMIHLYLPISFLN

SEQ ID NO: 768 - protein, 447 aa, Brassica nigra
MKLLHGLALVFLLATTSCKADEEITCEENNPFTCSNTDILSKGKVSRGVNQGGLQYYHKLIDALLEKNITPFVTLYHWDLPQTLQDEYEGFLDRQIIQDFKDYADLCFKEFGGKVKHWITINQLYTVPTRGYALGTDAPGRCSYMVDNKHRCYGGNSSTEPYIVAHNQLLAHATIVDLYRTKYKFQKGKIGPVMITRWFLPYDESDPSCVEAAERMNQFFHGWYMEPLTKGRYPDIMRQIVGSRLPNFTEAEAELVAGSYDFLGLNYYVTQYAQPKPNPYPSETHTALMDAGFVEDKDNGNSYYYPKGIYYVMDYFKTKYGDPLIYVTENGFSTPTTENRGEAIADYKRIDYLCSHLCFLRKVIKEKGVNVRGYFAWALGDNYEFCKGFTVRFGLSYVNWDDLDDRNLKESGKWYQRFINGTAKNPAKQDFLRSSVSSQSQKKRLAC

SEQ ID NO: 769 - protein, 476 aa, Brassica nigra
MAQGSINTNTYIYLLTMKLHGLALIGFLIAAASCKAIEDINCQENEPFTCGNTDQLSKGKVSRGVNKGGLEYYHKLIDGLVAKNITPFVTLYHWDLPQTLQDEYEGFLNRTIIDDFRDYADLCFKEFGGKVKNWITINQLYTVPTRGYAIGTDAPGRCSPKVDERCYGGNSSTEPYIVAHNQLLAHAAAVDVYRTKYKFQGGKIGPVMITRWFLPFDETDKASLDAADRMKEFFLGWFMEPLTKGRYPDIMRQIVGSRLPNFTEAEAELVAGSYDFLGLNYYTTQYAQPKPNPVTWENHTAMMDPGAKLTFDVYTYASFSQFVKDEINGDAYYYPKGIYYVMDYFKTKYRNPLIYITENGFSTPGDETREEAIADSKRIDYLCSHLCFLRKVIREKRVNIKGYFAWALGDNYEFCKGFTVRFGLSYVNWTNLDDRNLKESGKWYQSFINGTSKNPAKQDFLRPNLSFQNQKKLADA

SEQ ID NO: 770 - protein, 392 aa, Brassica nigra
MYNIYMYARAEGKVSRGVNQGGLDYYHQLIDALLEKNITPFVTLFHWDLPQTLQDEYEGFLDRQIIQDFKDYADLCFNEFGGKVKHWITINQLYTVPTRGYASGTDAPGRCSYMVDTKHRCYGGNSSTEPYIVAHNQLLAHAAVVDLYRTKYKFQNGKIGPVMITRWYMEPLTKGRYPDIMRQIVGSRLPNFTEEEAALVAGSYDFLGLNYYVTQYAQPQPNPYPSETHTAMMDPGVKLTYKVNGNSYYYPKGIYYVMDFFKTNYSNPLIYITENGISSPGTENRCEAIADYKRIDYLCSHLCFLRKVIREKGVNVRGYFAWALGDNYEFCKGFTVRFGLSYVNWDDLDDRNLKESGKWYQRFINGTVKNHADQDFLRSSLSSQSQKKRLAC

SEQ ID NO: 771 - protein, 306 aa, Brassica rapa
MGELNATGYRFSFAWSRIIPITCINEMILYNMHRQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGCYYYPKGIYYVMDYFKTKYGDPLIYVTENGFSTPSEENREQAIADYKRIDYLCSHLCFLRKVIKEKGVNVRGYFAWALGDNYEFCKGFTVRFGLSYVNWEDLDDRNLKESGKWYQRFINGTVKNAVKQDFLRSSLSSQSQKKRFADA

SEQ ID NO: 772 - protein, 262 aa, Brassica rapa
MQKDVDVMGELNATGYRFSFAWSRIIPKGKVSRGVNQGGLDYYHKLIDALLEKNITPFVTLFHWDLPQTLQDEYEGFLDRQIIQDFKDYADLCFKEFGGKVKHWITINQLYTVPTRGYAIGTDAPGRCSPMVDTKHRCYGGNSSTEPYIVAHNQLLAHATVVDLYRTKYKFVEDKVNGNSYYYPKGIYYVMDYFKTKYGDPLIYVTENGFSTPSSENREQAIADYKRIDYLCSHLCFLRKVINYIMTSEDDEERGKITKFKT

SEQ ID NO: 773 - protein, 443 aa, Brassica oleracea
MQLRMVVSFHFRSKEGEVVVLTFGMASVTDIQKSGSHKLIDALLEKNITPFVTLFHWDLPQTLQDEYEGFLDRQIIQDFKDYADLCFKEFGGKVKHWITINQLYTVPTRGYAIGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAELVAGSYDFLGLNYYVTQYAQPKPNPYPSETHTAMMDAGVKLTYDNSRGEFLGPLFVEDKVSGNSYYYPKGIYYVMDYFKTKYGDPLIYVTENGFSTPSSENREQAIADYKRIDYLCSHLCFLRKVIKEKGVNVRGYFAWALGDNYEFCKGFTVRFGLSYVNWEDLDDRNLKESGKWYQRFINGTVKNSAKQDFLRSSLSSQSQKKRLADA

SEQ ID NO: 774 - protein, 335 aa, Brassica campestris
MKLQKDVDVMGELNATGYRFSFAWLRIIPKGKASRGVNQGGLDYYHKLIDALLEKNITPFVTLFHWDLPQTLQDEYEGFLDRQIIQDFKDCADLCFKEFGGKVKHWITINQLYTVPTRGYAVGTDAPGRCSPMVDTKHRCYGGNSSTEPYIVAHNQLLAHATVVDLYRTKYKFQKGKIGPVKITRWFLPFDESDPATIEAAESMNQFFHGWYMEPLTKGRYPDIMRQIVGSRLPNFTEEEAQLVAGSYDFLGLNYYVTQYAQPKPNPYPSETHTAMMDAGVKLTYKDNGNSYYYPKGIYYVMDYFKTNYGNPLIYVTENGEFYILLLLYFHLYHA

SEQ ID NO: 775 - protein, 484 aa, Brassica oleracea
MKLLHGLALVFLLAAASCKADEEITCEENNPFTCSNTDILSSKNFGKDFIFGVASSAYQASEGKVSRGVNQGGLDYYHKLIDALLEKNITPFVTLFHWDLPQTLQDEYEGFLDRQIIQDFKDYADLCFKEFGGKVKHWITINQLYTVPTRGYAIGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAELVAGSYDFLGLNYYVTQYAQPKPNPYPSETHTAMMDAGVKLTYDNSRGEFLGPLFVEDKVSGNSYYYPKGIYYVMDYFKTKYGDPLIYVTENGFSTPSSENREQAIADYKRIDYLCSHLCFLRKVIKEKGVNVRGYFAWALGDNYEFCKGFTVRFGLSYVNWEDLDDRNLKESGKWYQRFINGTVKNSAKQDFLRSSLSSQSQKKRLADA

SEQ ID NO: 776 - protein, 294 aa, Brassica napus
MGSDSTPQLPVIYLSDQTLKPGSEKWVEVRSDVRKALEDYGAFEVPYDRVSEELKQSVLEAMKELFELPVEAKRRNVSPKPYTGYSTHNGLSESLGIQDPEVLEKVNEFTQLLRPDCEGNKSISETIQKFSEKLAELDVMVRRMVMESFGIEKYFDEHLKSTNYRLRLMKYIAPPDIEGLEVLNKDEKWIRLKPSRNSFVVMAGDSVYALMNGRLFRPFHRVRVTEKKKTRYSIALFSTPIAGYIIEPPKELVDEKHPRVFKPFTYVDLMSFYHTEAGRRARSTLHAYCAVSEA

SEQ ID NO: 777 - protein, 294 aa, Brassica napus
MGSDSTPQLPVIYLSDQTLKPGSEKWVEVRNDVRKALEDYGAFEVSYDRVSEELKQSVLEAMKELFELPVEAKRRNVSPKPYTGYSTHNGLSESLGIQDAEVLEKVNEFTQLLRPDFEGNKSISETIQKFSEKLAELDVMVRRMVMESFGIEKYFDEHLKSTNYRLRLMKYIAPPDIEGLEVLNKDEKWIRLKPSRNSFVVMAGDSVYALMNGRLFRPFHRVRVTEKKKTRYSIALFSTPNAGYIIEPPKELVDEKHPRVFKPFTYVDLMSFYHTEGGRRARSTLHAYCAVSEA

SEQ ID NO: 778 - protein, 402 aa, Brassica napus
MGADTPQLPVIYLSDQTLKPGSEKWVEVRSDVRKALEDYGAFEVSYDRVSEELKKSVLDAMIELFELPVEAKQRNVSPKPYTGYSTHNGLSESLGIQDSNVLEKVNEFTQLLRPDCEGNKTMSETIQNFSEKLAELDVMVRRMVIESFGIENYFDEHLKSTNYRLRLMKYVAPPDVDANVAVGTKDSDDGANTNTTANADADDIANGIAKVHIDDDADAKGDSNVDVGTNVSAKSSANTGTRTSATVGVSDSVKANGGADDEEKKLGLPSHTDKNLLTVLYQYEIEGLEVLTKDEKWIRLKPCHNSFVVMAGDSLYALMNGRLSRPFHRVRVTERKKTRYSIALFSTPNGDYIIEPPKELVDEKHPRLFKPFTYVDLMSFYHTEAGRRPHSTLHAYCAVSGA

SEQ ID NO: 779 - protein, 439 aa, Brassica napus
MGADTPQLPVIYLSDQTLKPGSEKWLEVRSDVRKALEEYGGFEVSYDKVSEELKKSVLDAMIELFELPVEAKQRNVSPKPYTGYSTHNGLSESLGIQDSNVLEKVNEFTQLLRPDCEGNKTMSETIQNFSEKLAELDVMVRRMVIESFGIENYFDEHLKSTNYRLRLMKYVAPPDVDANVAVGTKDSDDGANTNTTANADADDIANGIAKVHIDDDADAKGDVCTGAGTNHNGDDVNTGDCANVKSNVDVGTNVSAKSSVGADVNTGTIDDVNANAGTRSSANVGVSDSVKANGGADDEEKKLGLPSHTDKNLLTVLYQYEIEGLEVLTKDEKWIRLKPSHNSFVVMAGDSLYALMNGRLSRPFHRVRVTERKKTRYSIALFSTPNGDYIIEPPKELVDEKHPRLFKPFTYVDLMSFYHTEAGRRARSTLHAYCAVSGA

SEQ ID NO: 780 - protein, 358 aa, Brassica napus
MGSDSTPQLPVIYLSDQTLKPGSEKWVEVRSDVRKALEDYGAFEVSYDRVSEELKESVLETMKELFQLPVEAKRRNVSPKPYTGYMTHNGVSESLGIQDANVLEKVNEFTQLLRPDCEGNKSTSERIHKFSEKLAELDVMVRRMVFESFGIEDYFDENLKSMNYRLRLMKYTAPRDVDTNVAAGANDAGDGANTNNNGNTGADAGAGDSASTGDNDKVVASDDANAGADTNDIVVGIANVHIDDDANDVAKANGDVGAGVDANTNDCASVKSNADVDNVNANASVGTNGDGDTNANVGAHLEEKKLGLPSHTDKNLLTVLYQHEIEGLEVLTKDEKWIRLKPSHNSFVVIAGDSLYVR

SEQ ID NO: 781 - protein, 432 aa, Brassica nigra
MGSDSTPQLPVIYLSDQTLKPGSEKWVEVRSDVRKALEDYGAFEVSYDRVSEELKESVLEAMKELFDLPVEAKQRNVSPKPYTGYSTHNGLSESLGIQDAEVLEKVNEFTQLLRPDCEGNKSISETIQKFSEKLAELDVMVRRMVMESFGIEKYFDEHLKSTNYRLRLMKYIAPPEVDTNVAVGTNDAGDGANDASASDKANVFAGDEDNVGADTSDIANGIANVHIDDDAKANGDIGADVDAKTSDCANVESKADVSTDVNANSDSNANTGTLSSASVGDIVKANGGADDEEKKLGLPSHTDKNLFTVLYQYEIEGLEVLTKDEKWIRLKPSHNSFVVMAGDSAYALMNGRLFRPFHRVRVTEKKKTRYSIALFSTPNAGNIIEPPKELVDEKHPRVFKPFPYVDLMSFYHTEAGRRARSTLHAYCAVSEA

SEQ ID NO: 782 - protein, 540 aa, Raphanus sativus
MTTMMSLTTSLPYPFQILLVFILSMASITLLGRILSRPTKTKDRSRQLPPGPPGWPILGNLPELMMTRPRHKYIDIALKGQKPEIACFNFAGTHAIVINSDEIAREALKERDADFADRPNLFNMRTIGGNHKSMGNSPYGEQFIKMKRVITTEIMSVRTLNMLVAARTIEADNLLAYLLSMYKRSEKADVREFSRAYGYAVTMRMMFGRRHVTKENVFSDEGRLGEAEKDHLDAIFETLNCLPSFSPADYLEKWFRGWNIDGQEERVVRYVNKVRSYNNPIIDERVELWREKGGKAAVEDWIDTFITLKDENGKYYITPDEVKGQCVEFCIAAIDNPANNMEWTLAEMLKNPEILKKALKELDEVVGRDRLVQESDIPNLNYLKACCRETFRIHPSAHYVPTHVARQDTTLGGYFIRKGSHIHVARPGIGRSSKVWKDPLVYKPERHLEVDGVSKELSLVETELRFVSFGTGRRGCIGVKVGTIMMVIMLARFLQAFNWKLHPGYGPLSLEEDDALLMAKPLLLSVEPRLAPNLYPKFCP

SEQ ID NO: 783 - protein, 540 aa, Brassica napus
MTMMMSLTTSLPYPFQILLVFILSMASITLLGRILSRPTKTKDRSRQLPPGPPGWPILGNLPELMMTRPRHKYVDIAMKGQKPDIACFNFAGTHAIIINSDEIAREALKERDADFADRPNLFNMRTIGGNHKSMGNSPYGEQFMKMKRVITTEIMSVKTLNMLVAARTIEADNLLAYLLSMYKRSETADVREFSRVYGYAVTMRLLFGRRHVTKENVFSDEGRLGQAEKDHLDAIFETLNCLPSFSPADYLEKWFRGWNIDGQEERVVMYCNKVRSYNNPIIDERVELWREKGGKAAVEDWIDTFITLKDENGKYYITPDEVKAQCVEFCIAAIDNPANNMEWTLAEMLKNPEILKKALKELDEVVGRDRLVQESDIPNLNYLKACCRETFRIHPSAHYVPTHVARQDTTLGGYFIPKGSHIHVGRPGIGRSSKIWTDPLVYKPERHLEGDGISKELSLVETELRFVSFGTGRRGCVGVKVGTIMMVIMLARFLQAFNWKLHPGYGPLSLEEDDALLMAKPLLLSVEPRLAPNLYPKFCP

SEQ ID NO: 784 - protein, 540 aa, Brassica napus
MTMMMSLTTSLPYPFQILLVFILSMASISLLGRILSRPTKTKDRSRQLPPGPPGWPILGNLPELMMTRPRHKYIDIALKGQNPEIACFNFAGTHAIVINSDEIAREALKERDADFADRPNLFNMRTIGGNHKSMGNSPYGEQFMKMKRVITTEIMSVKTLNMLVAARTVEADNLLAYLLSMYKRSETADVREFSRVYGYAVTMRLLFGRRHITKENVFSDEGRLGQAEKDHLDAIFETLNCLPSFSPADYLEKWFRGWNIDGQEERVVMYCNKVRSYNNPIIDERVELWREKGGKAAVEDWIDTFITLKDENGKYYITPDEVKAQCVEFCIAAIDNPANNMEWTLAEMLKNPEILKKALKELDEVVGRDRLVQESDIPNLNYLKACCRETFRIHPSAHYVPTHVARQDTTLGGYFIPKGSHIHVGRPGIGRSSKVWKDPLVYKPERHLEGDGISKELSLVESELRFVSFGTGRRGCVGVKVGTIMMVIMLARFLQAFNWKLHPGYGPLSLEEDDALLMAKPLLLSVEPRLAPNLYPKFCP

SEQ ID NO: 785 - protein, 541 aa, Brassica nigra
MTMMMMSLTTSLPYPFQILLVFILSIASITLLGRILSRPTKTKDRSRQLPPGPPGWPILGNLPELMKTRPRHKYFEIATKGQKPEIACFNFAGTHTIIINSDEIAREAFKERDADFADRPNTFNMRTIGGNHKSMGNTPTGEQFMKMKRVITSEIMSVKTLNMLVAARNIEADNLLAYLLSIYKRSETADVREISRNYGYAVTMRMMFGRRHVTKENVFSDEGRLGPAEKDHLDAIFETLNCLPSFSPADYLEKWFLGWNVDGLEERVTVNCNKVRSYNNPIIDERVELWREKGGKAAVEDWIDTFITLKDENGKYYITPDEVKGQCVEFCIAAIDNPANNMEWTLAEMLKNPEILKKALKELDEVVGRDRLVQESDIPNLNYLKACCRETFRVHPSAHYVPTHVARRDSTLGGYFIPKGSHIHVARPGIGRSSKVWKDPLVYKPERHLEGNGISKELSLVENEMRLVSFGTGRRGCIGVKVGTIMMVIMLARFLQAFNWKLHPSYGPLSLEEDDALLMAKPLLLSVEPRLAPNLYPKFYP

SEQ ID NO: 786 - protein, 540 aa, Brassica campestris
MTMMMSLTTSLPYPFQILLVFILSMASISLLGRILSRPTKTKDRSRQLPPGPPGWPILGNLPELMMTRPRHKYIDIALKGQKPEIACFNFAGTHAIVINSDEIAREALKERDADFADRPNLFNMRTIGGNHKSMGNSPYGEQFMKMKRVITTEIMSVKTLNMLVAARTVEADNLLAYLLSMYKRSETADVREFSRVYGYAVTMRLLFGRRHITKENVFSDEGRLGQAEKDHLDAIFETLNCLPSFSPADYLEKWFRGWNIDGQEERVVMYCNKVRSYNNPIIDERVELWREKGGKAAVEDWIDTFITLKDENGKYYITPDEVKAQCVEFCIAAIDNPANNMEWTLAEMLKNPEILKKALKELDEVVGRDRLVQESDIPNLNYLKACCRETFRIHPSAHYVPTHVARQDTTLGGYFIPKGSHIHVGRPGIGRSSKVWKDPLVYKPERHLEGDGISKELSLVESELRFVSFGTGRRGCVGVKVGTIMMVIMLARFLQAFNWKLHPGYGPLSLEEDDALLMAKPLLLSVEPRLAPNLYPKFCP

SEQ ID NO: 787 - protein, 540 aa, Brassica oleracea
MTMMMSLTTSLPYPFQILLVFILSMASITLLGRILSRPTKTKDRSRQLPPGPPGWPILGNLPELMMTRPRHKYVGIAMEGQKPDIACFNFAGTHAIIINSDEIAREALKERDADFADRPNLFNMRTIGGNHKSMGNTPYGEQFMKMKRVIRTEIMSVKTLNMLEAARTIEADNLLAYLLSMYKRSETADAREFSRGYGYAVTMRLLFGRRHVTKENVFSDEGRLGQAEKDHLDAIFETLNCLPSFSPADYLEKWFRGWNIDGQEERVVMSCNKVRSYNNPIIDERVELWREKGGKASVEDWIDTFITLKDENGKYYITPDEVKAQCVEFCIAAIDNPANNMEWTLAEMLKNPEILKKALKELDEVVGRDRLVQESDIPNLNYLKACCRETFRIHPSAHYVPTHVARQDTTLGGYFIPKGSHIHVGRPGIGRSSKIWTDPLVYKPERHLEGDGISKELSLVETELRFVSFGTGRRGCVGVKVGTIMMVIMLARFLQAFNWKLHPGYGPLSLEEDDALLMAKPLLLSVEPRLAPNLYPKFCP

SEQ ID NO: 788 - DNA, 175 bp, Artificial
  edited CYP79F1 allele
  misc_feature (26)..(27): n is a, c, g, or t
acaatgatgatgatgagccttaccanncatcgttaccgtacccttttcaaatcctactagtctttatcttgtccatagcatccatcactttgcttggccgaatactatcaagacccacaaaaaccaaagaccggtctcgtcagcttcctcctggaccaccaggatggcccatcct

SEQ ID NO: 789 - DNA, 172 bp, Artificial
  edited CYP79F1 allele
acaatgatgatgatgagccttaccacgttaccgtacccttttcaaatcctactagtctttatcttgtccatagcatccatcactttgcttggccgaatactatcaagacccacaaaaaccaaagaccggtctcgtcagcttcctcctggaccaccaggatggcccatcctcg

SEQ ID NO: 790 - DNA, 172 bp, Artificial
  edited CYP79F1 allele
acaatgatgatgatgagccttacatcgttaccgtacccttttcaaatcctactagtctttatcttgtccatagcatccatcactttgcttggccgaatactatcaagacccacaaaaaccaaagaccggtctcgtcagcttcctcctggaccaccaggatggcccatcctcg

SEQ ID NO: 791 - DNA, 175 bp, Artificial
  edited CYP79F1 allele
  misc_feature (26)..(27): n is a, c, g, or t
ttttcaaatcctactagtctttatcnnttgtccatagcatccatcactttgcttggccgaatactatcaagacccacaaaaaccaaagaccggtctcgtcagcttcctcctggaccaccaggatggcccatcctcggcaatttacccgaactaatgaagactcgtcctaggcaca

SEQ ID NO: 792 - DNA, 171 bp, Artificial
  edited CYP79F1 allele
ttttcaaatcctactagtctttatcccatagcatccatcactttgcttggccgaatactatcaagacccacaaaaaccaaagaccggtctcgtcagcttcctcctggaccaccaggatggcccatcctcggcaatttacccgaactaatgaagactcgtcctaggcacaaa

SEQ ID NO: 793 - DNA, 171 bp, Artificial
  edited CYP79F1 allele
ttttcaaatcctactagtcttttgtccatagcatccatcactttgcttggccgaatactatcaagacccacaaaaaccaaagaccggtctcgtcagcttcctcctggaccaccaggatggcccatcctcggcaatttacccgaactaatgaagactcgtcctaggcacaaa

SEQ ID NO: 794 - DNA, 170 bp, Artificial
  edited CYP79F1 allele
acaatgatgatgatgagccttaccattaccgtacccttttcaaatcctactagtctttatcttgtccatagcatccatcactttgcttggccgaatactatcaagacccacaaaaaccaaagaccggtctcgtcagcttcctcctggaccaccaggatggcccatcctcg

SEQ ID NO: 795 - DNA, 170 bp, Artificial
  edited CYP79F1 allele
ttttcaaatcctactagtctttgtccatagcatccatcactttgcttggccgaatactatcaagacccacaaaaaccaaagaccggtctcgtcagcttcctcctggaccaccaggatggcccatcctcggcaatttacccgaactaatgaagactcgtcctaggcacaaa

SEQ ID NO: 796 - DNA, 170 bp, Artificial
  edited CYP79F1 allele
atttgaaaagggtacggtaatggtaaggctcatcatcatcattgtcatgatgtttgtgtgtgtgagtttagagagagatgtgtgctcgttagcaatgaacactaacaagtttgagaaactgtctcttgtgttttaactatttatagatccgatatcatgcatgtgatgct

SEQ ID NO: 797 - DNA, 170 bp, Artificial
  edited CYP79F1 allele
atttgaaaagggtacggtaacgatgaggctcatcatcatcattgtcatgatgtttgtgtgtgtgagtttagagagagatgtgtgctcgttagcaatgaacactaacaagtttgagaaactgtctcttgtgttttaactatttatagatccgatatcatgcatgtgatgct

SEQ ID NO: 798 - DNA, 170 bp, Artificial
  edited CYP79F1 allele
atttgaaaagggtacggtaacgataaggctcatcatcatcattgtcatgatgtttgtgtgtgtgagtttagagagagatgtgtgctcgttagcaatgaacactaacaagtttgagaaactgtctcttgtgttttaactatttatagatccgatatcatgcatgtgatgct

SEQ ID NO: 799 - DNA, 170 bp, Artificial
  edited CYP79F1 allele
gcaaagtgatggatgctatggacaaagactagtaggatttgaaaagggtacggtaacgatgtggtaaggctcatcatcatcattgtcatgatgtttgtgtgtgtgagtttagagagagatgtgtgctcgttagcaatgaacactaacaagtttgagaaactgtctcttgt

SEQ ID NO: 800 - DNA, 172 bp, Artificial
  edited AOP2 allele
ctttcatggcttccaaaaccgatttaagctcctctgacactctatcatatgacacctcgaacgcgccgtagtcttcaagagctttacggacatcactcctcacttcaacccacttctcacttcctggttttagggtttggtccgagagatggatgactggaagttgaggagt

SEQ ID NO: 801 - DNA, 168 bp, Artificial
  edited AOP2 allele
ctttcatggcttccaaaacttaagctcctctgacactctatcatatgacacctcgaacgcgccgtagtcttcaagagctttacggacatcactcctcacttcaacccacttctcacttcctggttttagggtttggtccgagagatggatgactggaagttgaggagt

SEQ ID NO: 802 - DNA, 166 bp, Artificial
  edited AOP2 allele
ctttcatggcttccaaaacaagctcctctgacactctatcatatgacacctcgaacgcgccgtagtcttcaagagctttacggacatcactcctcacttcaacccacttctcacttcctggttttagggtttggtccgagagatggatgactggaagttgaggagt

SEQ ID NO: 803 - DNA, 166 bp, Artificial
  edited AOP2 allele
ctttcatggcttccaaaaccgactcctctgacactctatcatatgacacctcgaacgcgccgtagtcttcaagagctttacggacatcactcctcacttcaacccacttctcacttcctggttttagggtttggtccgagagatggatgactggaagttgaggagt

SEQ ID NO: 804 - DNA, 174 bp, Artificial
  edited AOP2 allele
ttttagggtttggtccgagagatgatgactggaagttgaggagtactgtctgaacccattcttctttcctttggtgcatatccaaaaaaatacatttacaaatgtaaattagcttttaacttaactcaatttttagttagctctttaatatataacaacaaatgaaagcgcgtt

SEQ ID NO: 805 - DNA, 174 bp, Artificial
  edited AOP2 allele
ctttcatggcttccaaaaccgattcttaagctcctctgacactctatcatatgacacctcgaacgcgccgtagtcttcaagagctttacggacatcactcctcacttcaacccacttctcacttcctggttttagggtttggtccgagagatggatgactggaagttgaggagt

SEQ ID NO: 806 - DNA, 171 bp, Artificial
  edited AOP2 allele
ttttagggtttggtccgagagatgactggaagttgaggagtactgtctgaacccattcttctttcctttggtgcatatccaaaaaaatacatttacaaatgtaaattagcttttaacttaactcaatttttagttagctctttaatatataacaacaaatgaaagcgcgtt

SEQ ID NO: 807 - DNA, 168 bp, Artificial; identical to SEQ ID NO: 801
  edited AOP2 allele

SEQ ID NO: 808 - DNA, 164 bp, Artificial
  edited AOP2 allele
ctttcatggcttccaataagctcctctgacactctatcatatgacacctcgaacgcgccgtagtcttcaagagctttacggacatcactcctcacttcaacccacttctcacttcctggttttagggtttggtccgagagatggatgactggaagttgaggagt

SEQ ID NO: 809 - DNA, 164 bp, Artificial
  edited AOP2 allele
ctttcatggcttccaaaaagctcctctgacactctatcatatgacacctcgaacgcgccgtagtcttcaagagctttacggacatcactcctcacttcaacccacttctcacttcctggttttagggtttggtccgagagatggatgactggaagttgaggagt

SEQ ID NO: 810 - DNA, 168 bp, Artificial
  edited AOP2 allele
ctttcatggcttccaaaaccgattctcctctgacactctatcatatgacacctcgaacgcgccgtagtcttcaagagctttacggacatcactcctcacttcaacccacttctcacttcctggttttagggtttggtccgagagatggatgactggaagttgaggagt

SEQ ID NO: 811 - DNA, 174 bp, Artificial
  edited AOP2 allele
acagtactcctcaacttccagtcaccatctctcggaccaaaccctaaaaccaggaagtgaaaagtgggttgaagtgaggagtgatgtccgtaaagctcttgaaaactacggcgcgttcgaggtgtcatatgatagagtgtcagaggagcttaaggaatcggttttggaagccat

SEQ ID NO: 812 - DNA, 171 bp, Artificial; identical to SEQ ID NO: 806
  edited AOP2 allele

SEQ ID NO: 813 - DNA, 173 bp, Artificial
  edited AOP2 allele
ctttcatggcttccaaaaccgattctaagctcctctgacactctatcatatgacacctcgaacgcgccgtagtcttcaagagctttacggacatcactcctcacttcaacccacttctcacttcctggttttagggtttggtccgagagatggatgactggaagttgaggagt

SEQ ID NO: 814 - DNA, 169 bp, Artificial
  edited AOP2 allele
ctttcatggcttccaaaaccttaagctcctctgacactctatcatatgacacctcgaacgcgccgtagtcttcaagagctttacggacatcactcctcacttcaacccacttctcacttcctggttttagggtttggtccgagagatggatgactggaagttgaggagt

SEQ ID NO: 815 - DNA, 169 bp, Artificial
  edited AOP2 allele
ctttcatggcttccaaaaccgattcctcctctgacactctatcatatgacacctcgaacgcgccgtagtcttcaagagctttacggacatcactcctcacttcaacccacttctcacttcctggttttagggtttggtccgagagatggatgactggaagttgaggagt

SEQ ID NO: 816 - DNA, 171 bp, Artificial; identical to SEQ ID NO: 806
  edited AOP2 allele

SEQ ID NO: 817 - protein, 358 aa, Brassica juncea
MKLLHGLALVFLLAAASCKADEEITCEENNPFTCSNTDILSSKNFGKDFIFGVASSAYQIEGGRGRGVNIWDGFSHRYPEKSGSDLKNGDTTCESYTRWQKDVDVMGELNATGYRFSFAWSRIIPEGKVSRGVNQGGLDYYHKLIDALLEKNITPFVTLFHWDLPQTLQDEYEGFLDRQIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEALLVAGSYDFLGLNYYVTQYAQP

SEQ ID NO: 818 - protein, 101 aa, Brassica juncea
PNPYPSETHTAMMDAGVKLTDDNSRGEFLGPLVNGNSYYYPKGIYYVMDYFKTKYGDPLIYVTENLGFSTPSEENREQAIADYKRIDYLCSHLCFLRKVIK

SEQ ID NO: 819 - DNA, 162 bp, Brassica juncea
cttccagtgatctatctctcggaccaaaccctaaaaccaggaagtgagaagtgggttgaagtgaggaatgatgtccgtaaagctcttgaagactacggagctttcgaggtgtcatatgatagagtgtcagaggagctaaagcaatcggttttggaagccatg

SEQ ID NO: 820 - DNA, 162 bp, Brassica juncea
agaagaatggtatttgagagctttgggatagaggattactttgatgagaacctcaagtcaatgaattaccgtctacgactgatgaagtattcagcaccacgtgatgttgatacgaatgttgcggcaggtgctaatgatgctggtgatgctgctaatacgaat

SEQ ID NO: 821 - DNA, 162 bp, Brassica juncea
ccagtcatctatctctcggaccaaaccctaaaaccaggaagtgagaagtgggttgaagtgaggagtgatgtccgtaaagctcttgaagactacggcggttttgaggtgtcatatgatagagtgtcagaggagctgaagaagtcagttttggatgccatgata

SEQ ID NO: 822 - DNA, 162 bp, Brassica juncea
cttccagtgatctatctctcggaccaaaccctaaaaccaggaagtgagaagtgggttgaagtgaggagtgatgtccgtaaagctcttgaagactacggcgctttcgaggtgtcatatgatagagtgtcagaggagcttaaggaatcggttttggaagccatg

SEQ ID NO: 823 - DNA, 162 bp, Brassica juncea
ccagtcatctatctctcggaccaaaccctgaaaccaggaagtgagaagtgggctgaagtcaggagtggtgtccgtaaagctctcgaagaatatggtgctttcgaggtgtcatatgatagagtgacagaggagcttaagaagtcagttttggatgccatgata

SEQ ID NO: 824 - protein, 54 aa, Brassica juncea
LPVIYLSDQTLKPGSEKWVEVRNDVRKALEDYGAFEVSYDRVSEELKQSVLEAM

SEQ ID NO: 825 - protein, 54 aa, Brassica juncea
RRMVFESFGIEDYFDENLKSMNYRLRLMKYSAPRDVDTNVAAGANDAGDAANTN

SEQ ID NO: 826 - protein, 53 aa, Brassica juncea
VIYLSDQTLKPGSEKWVEVRSDVRKALEDYGGFEVSYDRVSEELKKSVLDAMI

SEQ ID NO: 827 - protein, 54 aa, Brassica juncea
LPVIYLSDQTLKPGSEKWVEVRSDVRKALEDYGAFEVSYDRVSEELKESVLEAM

SEQ ID NO: 828 - protein, 54 aa, Brassica juncea
PVIYLSDQTLKPGSEKWAEVRSGVRKALEEYGAFEVSYDRVTEELKKSVLDAMI

That which is claimed is:

1. A *Brassica juncea* plant or part thereof comprising at least one mutation in an endogenous gene encoding a myrosinase, wherein the plant or part thereof comprising at least one mutation in an endogenous gene exhibits a reduction in the activity of the myrosinase, wherein the endogenous gene encoding the myrosinase comprises a nucleotide sequence encoding a polypeptide having at least 80% sequence identity to any one of the amino acid sequences of SEQ ID NOs: 93-105.

2. The *B. juncea* plant or part thereof of claim 1, wherein the plant or part thereof comprising at least one mutation in an endogenous gene exhibits reduced hydrolysis of glucosinolates, wherein reduced hydrolysis of glucosinolates results in reduced production/amounts of thiocyanates, reduced production of glucose, reduced hydrolysis of sinigrin and/or reduced amounts/production of alkenyl glucosinolates and/or aliphatic glucosinolates.

3. The *B. juncea* plant or part thereof of claim 1, wherein when eaten, the *B. juncea* plant or part thereof comprising at least one mutation in an endogenous gene exhibits reduced pungency and/or reduced bitterness.

4. The *B. juncea* plant or part thereof of claim 1, wherein the at least one mutation is results in a null allele and the null allele is a full knockout mutant myrosinase allele, optionally, wherein the full knockout mutant myrosinase allele results in the production of a nonfunctional myrosinase protein or no production of a myrosinase protein.

5. A method for editing a specific site in the genome of a *B. juncea* plant cell, the method comprising: cleaving, in a site specific manner, a target site within an endogenous myrosinase gene, thereby generating an edit that reduces the activity of in the endogenous myrosinase, wherein the endogenous myrosinase gene comprises a nucleotide sequence encoding a polypeptide having at least 80% sequence identity to any one of the amino acid sequences of SEQ ID NOs: 93-105.

6. The method of claim 5, further comprising regenerating a *B. juncea* plant from the plant cell comprising an edit in the endogenous myrosinase gene to produce a plant comprising the edit in its endogenous myrosinase gene.

7. The method of claim 6, wherein the *B. juncea* plant comprising the edit in its endogenous myrosinase gene exhibits reduced pungency and/or bitterness.

8. A method of producing a *B. juncea* plant or part thereof comprising a mutated endogenous myrosinase gene and having a phenotype of reduced pungency and/or bitterness, the method comprising contacting a target site in an endogenous myrosinase gene with a nuclease comprising a cleavage domain and a DNA binding domain comprising a nucleic acid binding domain that binds to the target site in the endogenous myrosinase gene, thereby producing a mustard plant or part thereof having reduced pungency and/or bitterness and comprising a mutated endogenous myrosinase gene that results in a reduction in myrosinase activity, wherein the endogenous myrosinase gene comprises a nucleotide sequence encoding a polypeptide having at least 80% sequence identity to any one of the amino acid sequences of SEQ ID NOs: 93-105, optionally wherein the mutation is a base substitution, a base insertion and/or a base deletion.

* * * * *